United States Patent 9,567,581 (SELECTIVE REACTIVATION OF GENES ON THE INACTIVE X CHROMOSOME) - sequence listing, part 23

SEQ ID NO: 3170 - DNA, 92733 bp, human
tgcacagaggttctccactttgttttctgaactcgcggtcaggtgagtaatgctatttctatgagataatgttgtagaaatgaggaacatgttagcttgggtttttttttctttcctattttccctccttcattgcaaattcccatccccataccaactttattcttttttgtttgttttgttttgtttttaactcctcactcccacttggagctctcttttcttcagatactttcttttccttggggattctattgttgacctgtttcttcttgctaacccaattgcttttgaatgggcgttcagaaatgggtaccgattttgaagttacatggtgcggtcaaagctggggaaagagaatgatcatttacgtggaattatttgggattctgtttcactgttttcccctttcctgctccctggacgtgtgtcccttggctctaacagcttttgtcatgttttgtaatggaccaaggaagtgtttgttctctctctgacctaagtgctgtgcaaatgcagctgtcaaaggatccttccaaccagatttctgcccatgaccctcttctagatagaaattctgaagccgctactttcacgcttcctatttctttcttttttcttttcttttctttctttctttcttttctttttttttttttttttttttttttgagacagggtctccctctgtcacccaggtaggagcgcagtggcgcagtcacagctcactgcagttttgacctcccaggctcaagtgatcctcccacctcagcctcctgagtaactgggaccacaggtgcatgcaaccatgcctggctaattttttattttttgtagagacgggatctccctatgctgccagacgggtctcaaactcctggcctcaatccatcctcctgcttcagcctcccaaagtgctgggattacaggcctgagccactgtacccagcctatttcttttgagactcataaatagtggtatttctgggaattcattgacataaattatcaaaattttgtaaacaatgtaaatgtctatcataatgaatacaaattagaatgatcccattataacttacatgataaataacacattgttattataatagatactagtaagttattgctataaataaggttataacagctgagcagggtcacacagccagtaaatggcccagctgggacctgaagcaggaattggcatggtgtgatgacaaaaccaaggaagggcacagaatcctggcgaggggtgggccctggtgggtgaggcggggttggtttcctgagtccctcacttcctctccagcatggtttcctagatgaccgccaaccatgtgcttttgccctatccctgccccagccctgcagtgcagatcaatgccccaggaggcttttaagaagagcctcttatttctctcctctacatattgatagaattattttgcagcagtagattctggaccaaatcaatgaaaaaatctttgtcgagtgcctgctgtgggtgtgggggtgaggtggagatcaagcctatataggagaggctattgtgttctgcttccttgtttttgtttttaggcaaagtcgagtctgatggaccatgaagagaaagtatcttttgtttgttgttttaaaaaaaatcactattgatttggccatgccaatgaccaatgaatctgagtagtggctattaagctatcgagggcaggaaagatatctgccttgttttttgtggtatctcaagtccctggcatagaatcttgcttgtaatagaacttcaataaacattcgtcaactagatgaatgaatgtcaattattttggaaataattccaaaatctgtttacagtttgtactggagtgtattataaacttatcttctttagctgagtatggtggcgtgtgcctatagtcccagctactcaggagcctgaggcaggaggatcgcttgagcctgggaggtggaggttgcagcaagccgagattgtaccactgcactccagcctgggtgacagagcaagaccctgtcacaaaaaaacaagcaaacaacagcaacaaccaaaaaacaataaaagaaacccaaaaacttgtcttctaattatgcttgtaatcatagctaacacttcttgactacactaagactttcattacattacctcatttaatccccacagaaccctgtgaaataggtcttagcattacttccacgtcttcagatgaagaatttaaactccagagaggttaaggaacagcccaagtttacactataagtggtggagcttagatgtgaaggcagacagatggctctaccatgcatgctcccgaatcctatgctattctgctcattattgtgtgttaaacatactgcaagcattgggggcagaccctgaagaatgaggggagagagatgaagtaggctttcaccttgcgttggataattcacacatggctaatcaagagtatggtagatcgcaggtatgagagagtggagaaatctggagatgagcaagggagccaaaaaacagaacacccctcagccgggcgcggtggctcacgtctagaatcccagcactttgggaggccgaggcgggtgggtcatctgaggtcaggagttcgagaccagcctggccaactgggtgaaaccctgtctctactaaaaatacaaaaattagccaggtgtggtggcaggcgcctgtaatcccagctactcaggaggctgaggcagaagaattgcttgaaccgggaggtggaggttgcggtgagccgagatcacgccattgcattccagcctgggtgacaagagcaaaactccgtctcaaaaaaaaaaaaacaaaaaccaaaccagacaaaaagcagaacacccctcaccaggtttggtgagtgtatgtttacattaagcgcacaatttagttctaatcttgcacgtctgatattgattcacttgttttattgaataaagcttcctttttctgcatcagaaagcacttaccgcttattaagaaaatcatttttgcactgtaaagaccaaatcatttccttccatttgattctagagatgtgtaagtttcacactgcaatgatgccatatggctcagcattggctttactttgtgctctgacaaacaacatacaaggctgctgttttagagttcctattcagcacttaccagttaacctagtttctgtcatctttaggacatggttgtttttggcatatgggatgttgtttctcttactacggtaatactggctttagttcttggtgaccttatcttcaaaaaattttgttgctgaagttcagaatagttccttttgtccaatatttattcaaactacctcaatttacaagatttgaaattgcttctagacatttctgtgagcattttggagaaatctgaaaacagtctcatttgatttatataatgggcaaaaatctaaggactttccttgtctggttttggcatcggggttatgatagccttgtaaaagtgagttcagatgtgctctttttcttgagtttctgtgcgattgaaactcttattccttaaatatttgatagaatcatcagtgaagccatctgggcctggagttttctttgtgggacaagttttgagacttttaatggttatacctactattcatgtttaccatttccacttgattccttcttggtaattggtatttttttctagaaatttgtccctttctatctagagtttcaaaattattgaagacagtttttgctaagagccttttatatttattatgtttatagcatttacaggtgtgttgctttttccgtacctcttattagctacttcctcactccctgcctctctctttttctcccctttttccctcccctccctctgtctcttgattttgccagaattgtcttttcaaagagcaacgttggctttgttaatctttatgtcttttttctgtttttattatatgcttttttttttattaccttccttcttcttctttgggtttattttgctgtactttttcacacttcttaagaaccttaattcattaattttaagcctttctctttttctaatttgtatgtttaaaatataattttcactctatctttagctgtatcctatgtgttttatatacagtgtttttcttattgatcaagtcgaatattttcttttttcttttatcttttttgtttttgagacaaggtcttgctctgttgcccaggctgcagtgcattggcgtgatcatggttcactacagcctctacctccttgcctcaagcgatcctcttgcctcagactcccatgcagctgggaccataggcgcataccaccatgcccggctaatttttttatttttttgtagagatggagggggggtcccactttgttgcccaggctgggctcgaactcctgggctcaggtaacccttctgccttggcctcccaaagtgctgggattacaggtgtgagccaccacgcctggcgaatattttctaataaacattgtgacttctttgacccatgggttatttgttaaataacacatctaactttttgttattacaccttaattgtgttgtggtcaaagaacatgctgcttttctgttttccaattgtttaaaaagcttttgagacttttctgttggtctggatggttttcacagacattccatgtgctcttgaaaagattatgcgcgctgcagttgttgaatgggggcttctagatatggtcctcatgttgttggttaaatgtgtgattcaaatattctatatccttaatgactttcttatttaatttttaccaattgctgatagagatctctcattatgattgtggatttgttctatttctccttatattctgtcaatgctgtttggtgtattttgaggctatagtagttgcattcacatgtaaatttcttcagtcttcaattcagaattgaatcttttatgaatgaacggttttatttctaggtaaagtattttgctttaaagtataatttgtctgatattagtataaacacattaattttcttttgattagtgtgggcatagcatatcttttccatctctttactttcaaactttctgaatcattaggttctatttgtgtccttgtaaatagcatataattggagtttgtatttttttcagtctgataatctttgccttttaatggaatcattgagtccatttatatttcatgaatcattgatctgcttttttttttttttttttgaaatagagtttcactcttgttgcccaggctggagtgtagtggcgcaatctcggctcactgcaacctctgcctcctgggttctagcgattctcctgcctcagcctcccaagtagcctgggattacaggcacctgacaccatacctggctaatttttttttttttttttttttttttttttagtagagacagagtttcatcatgttgatcaggctggtctcaaattcctgacctcaggtgatccacccgcttcggcctcccgaagtgttgggattacaggcgtgagccactgcaccggcctgcatttgtttttaaatctttattactttctatttttcctaaccattctttgttgctgtttctcctctttcttgccttttttcagactgactgaatatgttagaaactgttttcctcctccactagttaggaagttatatgtcccatttctgttgtttagttactaaagatattacaacctgttgtagaaattacaacatgtctactcaacttttcaatgtgtaaagataatcaatacctttagcttcctctagtataatccaaggaccttgaaagactttaatttttgaatttcattttgtcatctccttacttatattacatataatgcatatattgtctcctatgtttatatatatgaggtagttgccatatgtttttattttatcatgtttcactaatccctacaagatgttattgttttatatagtagttttgttttgtttcaagacacagtctccttctatcacccaggctggagtccagtggcacgatcttggctcactgcaacctccacctcccgggttcaagcaattctcctgcctcagcctcccaagaagctagggttacaggtgccagccaccacatctggctaatttttgtatttttagtaaagatggggtttcaccatgttggccaggctggtcttgaactcctgacctcaagtgatctgcccatctcggcctcccaaagtgctgggattacaggcgtgagccaccatgactggcactgttttatatagtaaaagttcatttggatttgccagtagagagtactacccctagttctgggcacctggggcctctggcctgtgacttgtgatttagagtcccctctctggcccttctctagctccacccttctccaaatggcaagaagtctgtggcaccaagaagtcatgcctacccggagctacctccctcttcccctcacccttgcttctagatcgtactctgggaatccgggaccctggaattcccaatccaaacattctgtgccaatttccaggacctgggcactccccttcctcattgcaagccatgctgcaggtgtacgtacccccagacccaagggatgaccaaggggtacatgcatgcaggagagggggttaggggtatgcaggctgtggtgatcacatgagtgtgcacaaagcctcttacagcttggaatgaagccttaggggaagaataagggcaaagccttcttttaaactcttgatctgtatcttagaaatgttagccatgggcctggccacaaacccaccactttctttgttcctcattcctcctttcatctcagttcttatgtcttttgcctaaatacatgttttaggattgatttcagtaatgatttgcaggtagggaacaacatcacagtttctgtttgtctgaaaatatcttcatcttgccctcattcttcaaagatattttccctgagagcagaattctaagttggcagtttgtttctggcacactgcagatagacttccactggttctggcttccattgttgcttctgagaagatagctgtcagtctaacagcagcttcttaacagcctttttctttctttctttcttttttttttttttttttttttgaggcgaagtcttgctctgttgcccaggctggagtgcagtagtgtgatctcagctcactgcaacctctgcctcccaggttcaagcgattctcctgcctcagcctccagagttgctgggattacaggtgggcgccaccacacctggctaatctatatatttttggtagagacgggggttccgcctcgttaggcaggctgacctcgaactcctggcctcaagtgatccatccgcctcggcctcccaaagtgctgggattacaggcatgagccactgcatgcccagcctaacagctgctcctttgaaggttatctgtcttgtatttctgacaatttttcagatgttcctgtttttgtttttgtttttttttttcattttcactatgatgtatctaggtgtagatctctttttatttcttttgattgagattctttgggctccttaaatctgaggattggtgtttttcacccatttggagacacttagtcattatcattccaaacactgattctctctttgaattttgtttaaatgtatgttagacattgtatttcttttctccatgtctctgaacttttctttcatatgtcatatttgaaactcaggtttgcctcattaggcccatacccacaggtataagtgggcttcattgcttacattacttacctgggttcctgcttgagtttcacctttggcctggcaattcctttctatctggccagctctttgatatgtttaagaaaatgcgcagctgggcatggtggctcacgcctataatcccagcactttgggaggccgagccgggtggatcaactgaggtcaggagttcgagactagcctggccaacatggtgaaaccccatctctactaaaaatagaaaaaattagccgggtgtggtggcaggcgcctgtaatcctagctactcaggaggctgagacaggagaatcgcttgaacctgggaggcggaggttgcagtgagccgagatcatgccactgctctccagcttgggagacagagcgagactccgcctcaaacaaacaaaaaaaaaaaaaaaaagaagaagaagaagaagaaagaaaatgcgctgggtgcggtggctcactcctgtaatcccagcactttgggaggctgaggcccaggagtttgagaccaggagttcaataccagcctaggcaacatggtaaaacttcatctctacaaaaaataaaaaaattagccaggcatggtggtacatgcctgtagtctcagctactcaggaggctgaggcaggaggatcaattgagcccacgaggttgaggctgcagtgaaccgtggtcatgccactgcactccagcctgggtgacagaatgagaccctgtctcaaaaaataaataattaataataataagaaaatgcttttagcattttattcatgatttttaattgtcttcagcccaaggtttgatctaactaacctaacccaacatattcccggaacactgaagacattttttttttccctgagatatttcctgtatcgaagtcattgagcagtgttcaaatagaaatttaattatgcttttcttaccagtttcctgattctttttctgacttctttgagaattgaacaatccaaatcaactgctttttcactttttgttctcactttatccacactgagaacccctgcagtccttctctttttacatttccccttgtggtggtcttgtaagccaacatatatgactccgtataaatgtctcaaaagcatagagttttctagaagacttagggaacaattatcatacctcttataactcaggtcagaaatattgatcattgtctatatcatagtggctatggtataatcaaagtatgccagttaaccagagataacagagaataaccctcacacagacctgccctatggtggtatcaagctatttctccctttctaatattattctttgattattctatatctaaagacagatttatcatttattggcataacaggttgcactgatgatatatatttcaaaaatatgatactgatactatttaatgaaattgaagagctctagaacgagtttttagagtggaagcaccacggcatatagtcatgtagttcgtgcactgtacaactctagagggaggttgccatttacatcagagttcacaacctaaaagggggccctggataaagatgaattggggatcatctttaatctagtgtcaaggtctacgtttcactgtttaaatgctaccaaatagttttctctgtaattgttgctatcttcctagccatccttagcaccttaaaaatttactaagaaccagtggctgttcagatcctctttgttgatgacctggatagcattgagctaacccagattgcaccagaagatgaatagatgtttgtgttaggctgttcttgcattgctgtaaagaaatccctgagactgggtcatttataagaaaaggggtttaattagctcctggttctgcacgctgtgcaagaagcatagtggcatttgcttctggggctcacttatcaccaaggggatggcccaagctattcatgaaggatcctccatgatccaacacctcccaccagctcacacctccaacattcaacatgagatttggatggggacacgtatccaaactatatcaatgttccagctgaaaaagagaaaaatggctttgatgtgcaatgactaaaggtttcaaacttcacagattgccctttgattagtgatcctagagactttatgacctaataggacattctcggtttatgcagaaggcagtaggagctacattatttcaaataccataaaacttctccaaaaacatatgttcagccttgaggaaacgtattccagatctgacaactgaaagcagtctgcattaagttcttgatctatatatttttttcaagatgattgctggggtcatctttcattctggcctttcctacctgcatttggaagttgagtagatcctgcctgtagtgaaaaggcatagtttattttgatcagaggtctcagttacagcacatagtagtcactcactgtgtatgtacactgagtcactgagtacacgaatttgcctttgatcatatcttgtacaccacttaggtcctgccctacgagttagcaaagctcaagaatgagtctttagacattcttaaattgtataataacattttgaacttgatgtctttcacctgatggactcaaaacattttacttacaaggagacaaagtctcaggaggctggcattgtgttctggtagaaagagtaagggttctgccaaatagctgaatgaccttgacccatcccctagacttgcaggggtgtccaatcttttggcttctctgggccacattggtagaagaattgtcatgggccgcacataaaatacactaacactattgatagctgatgagttaaaaaaaaaaaattgcaaaaaaactcataatgttttaaggaagtttacgaatttgtattgggccacattcaaaaccatcctgggccacatgtgacccgggggccagggttggacaagcttgcaatgatgggacctctttcatctgtagaacgagggttcgaggataggtgatttctgagttcctttccagaaataaaccactctgatactctctccccaggctacacttaaatacttgtgaattaaatctaagtcaactccaccagtttcaggtacagtcaagcctatttgtagaggagagcattttctgtggcactgaagttcactcaataatgccttcattttttttttttaaagcagtgcttttggaggggggacagagttcaaaaactttaaaaaatgttaatttttaaactttttattgaaacttatggcatacatatatgtgtacaactcagtgaatttcgtgaactgaacacacccatgtaattggcacacagaatattctcggtacctcagaagcctcccttgtgcccacatccaatattgttataactccctccctttcaaggataacccttctcctgacttctcaccacatcaattagttttttctgcttcggtttctcatgaatggaattatgtacaataagcactcttttgtctctggtttccttggcaaacattatatttctgagctgcactgagattgttttgtgtagctgtagcagacacttagatctttcctccagagagacatcgatacatctttgcacaactgtgttaacatcctcatttgagtgactcctttgggaagatcaataacatgccattatgcccagagagaggttaaaagaggagggagaaattagaggctttttataattgattaacatattctagcattaatacataatacaatttattaatttaagatatgcaagccctcttctgaaggagaaagattcacctcctggtctaaaacatcatcatgtcaggtcaaggaaagaatcactctcctagtgctggttatgagtattcaattacagaattcttaaagattgccagctttaccttgagacagaaactctgacttataaaacccctttctttccatgccctccaccccttaatcccagcactgcctgatcctgcacatactaggtgcaaaatagatatttgttgaatgaatgaatgaatgaatgaatgaatgaagagcacagctaacatttacagtgcattcacagtgccagccactgtgcaaagatttcttgtttactcaccgcaacagcactatcaggtgggtgctgttgtctcagtttgctagatggggaaacatgaccattggaaataacttgtccacagtcactcagatattatggggccaagttgggacctttgaactcatgctctttagtcttcaccactgtgtattcacactcactctagggcttgcagaagctgcaagtggtggctggattcatgagtgcccttggccgagagctctgctagctgaggacacacagcctggtttgtcccagccacttccctctggctgtgtagagggagcctgcccagttggctctcgccacccccttgcttgtgcctgtgcccatgagtgattcctttctcagcaccccacgccagcctctgctcctagtgctgactgcccatcttggggtaatgttggccaactcccagacatgagaggatcagacacagtcttagcatttgcaattctttctgtgtgctgaactctcccctagcccctgccccacctccagcacgtgcatttcatctagttcactcctattcagccctcacatctcatctggtacatattggccctcaataaatatttgttgaatgaataaatgaatgaatggtaaatgaggcttttaaattcaattctgatataaactactgaaatgcaagcaatgatgataaaataatatgcaacaaaaaggaaatgcaatgtactgatgaaactggatagttcccttgacccctctgtgggattcatgaaggagtggctcgcttactcagcccacagctctcaacccctcgtgggagggggagcacgcaggtgagtgggtacagaggccaggttgagtgcttctgggcaaccagcaggagcaggactctgtgcaggcccacagcagcgtctacaggttgcccgcgacccccgagccccagagggcatgtgttaccgcgcattcttttagcattgccatccttggacagtgtaagtgttaaacagttcagtggagggtcagtgtgacagcctcttgcacctgcaccaaggtctttgtctggcatccaggagtaatgaagttgtaagaacaaattggagggtggtgaatgcagaggattttattgctgatgaaagtggctctcagtgggatgggtggctggaaaggggatggagtgggaaggtggtcttcccctggagttcggccatctgcggctgaactcctccgaagtcgcactgtcaagccatccctctgaagtcaagctgctcctctccaaggtccggctacttctcttctctcctctgccactctgccagtggggcctgggatttttatgggtacaggatttgggggcagggcaggccagggtggttttggaaaaggcaacattcgggcagggaaatgagaatgcatgttctcacttttggctgcgggtccaggcttgagggtgtggcccttgtctagggccacactcttctacccaatatttccctgcctcctgtccatatcacttatccttttacagtataaaacatacaagagcgaaactccgtctcaaaaaaaacaaaaaacaaacaaaaaaaacatgaataggagctgggcacagtggtgctgcctgaggcaggaggattgcttgaagccacagtatactatgatcgcacctgtgaacagccattgcactccagcctgggctacatagcgagaccctatctctttaaaaaaaaatttttttaaggaaaaatgacatagagaaggataattattgaaaagattctgtgtaatggtaataatgatgtaacattttgtgttttttattccttctcttgttattttgcatgtgttgatgttttccataaatccacatggactaccttgcttctaagtataacatcctactgggcaaccctcccataataaacatgggttttgcttgttgtcaccagtgcccaactggcgtttctgattctctggaaccatagcaatttgaagtgcacaggatcacaggttgccttggttgaggaatgacctttgaggtattgctgtgttgtgattatggcagctgtgatgatctgtcttctccttactttattccaggatggttttctctgtcaggcagtgtggccatgttggcagaactgaagaagttttactgacgttcaagatattccttgtcatcatttgtcttcatgtcgttctggtaacatccctggaaggtaatgtgtctgtttttcttcattttttttttttctgtttatctgcatgtgtgtatttttttgttatttaggatttttttactgtggtaaaataacataatatttatcattttaaccatttttaagtgtacagttcattggcattaagtacattcacaattttgtgtaactgtcactgctatccatttctaaaacgttttcatcatcccaaatagaaactctatatccattaaacaataactcccaatttccttcccccccaccccttcctggtaacctctgttcctgttctttctatgtatttgcttattgcaagtaccttagataagtggaatcatacaatatttgtccttttgtgcctggcttatttcacttaggatgttttcaaggttcacccatgttgcagcatgtatcagaatttcattctttttaacagctaatgtttcactgtatgcattgacccattttgtctattcattcatccattgatgggcatttgggtcgtctcccccttttggctgttgtgaataatgctgctatgaacatgggtgtacaaatcactatttgagtccctgctttcatttctttggggtatatacctaggagggaattgctggatcatataaccctgtgttgaacatcttgagaaactgctaaactgttttccacagtggctatatccttttacatttctacaagcaaggcacaagaattccagtgtctcccattcttgacaatgcttgtattttcctgttgttttggtaatgggtgtgaagtggtatcttattgtggctttgatttgcattttcttaatgattagtgatattgagcatcttttcatgtgcttattggccacttgtatatcttctttggagaagtgtctattcaagtcctttgctcagttttgaattgggttgtttttgttggtgttgagttttgaagttctttgtgtattctggatattaatcccttatcagatatataacttacaaatattttctcccattctgtggggtgtttcttccactttcttaatagtatcatttcatgcataaattcttttaattttatgtagtctatttatttttacttttgttgtctatgctttggtgttatatcaaagaaatcattgccaaatccaatatcatgaagactttcccctatgttttcttccaagaattttatagttttagctcttatgtttaggtcctttgatcgatttatcatttttgtatatggtataaggtaacggtccaacttcactctcgtgcatgtgggtattgttttccagccacatttcttgaaaagactgcctttttgctattgaatggtcttggcaactttgtcaaaaatcactttgttataccagtggagggtgtctaggtttttggcatcttgaacaaataattggacaaaacgcactaacaaagcaaggaaggaatgaagagatttattgaaaatgaaagtacactccacagtgtgggagtggcccgagcacaggggctcaaagtccctgttacagaatttgtgggagtttccattggttacttggtgtatgccctatgtaaatgaagaggatgaagtaaagttacaaagtcatttactcagcatacaccctatggtgaggatatttcctgtcatagctgaagtgtgaatcggccttatgttccctgcctccagaccctattttcctgcctcaaagtgaccgtatagatgagggtttatttctggtgtttacttgtttttaaatgtatctacttgaaggtacaaccatatggaaatttaaaggtggtagagaatcagacagatgaagcagcctggtattttcggaaagggggatctttagaagttcatggaacaagaagaaaaggcatctgagaaaagcagttgaaagaccagcaatgctgggcctgcaatttctgtgggcacaactgccaaaggcaagtgtaaagaatcctcattaggaggttcacacctgtaatcccagcactttgggaggctgaggagggaggatcatttgaacccaggaattcaagacaagcctgagcaacatagtgagaccccgtctctacaaaaatgaaataacatgaaaaattagccgggcatggttgcgggtgtctgtattcctagctactcaggaggctgagatgggaggattgcttgagcccaggaggcggaggttgcagtaaacagtgaccataccagtgcagtccagcttgggtggcagagtacaaccctgcctcaaaaaaaaaaaaaaaaaaaaaaaaaaaagaagcatcctcattaggaatgggactaggaaatgattgatacttaagacatcaaggacacacaacgaaataactttcttattcagaagtgggtggcaggaccaaggaatctttattgcataagataaaaatctactagcagcaaacaacaaaacatacaaacaaataaaacacacatacaaatacacagactaaatggaaaacttcccaacaagctataacacaattggcaatcctttaaaaagtaggtactggggcacgttgtcaaaaagccgccattctttaaagaaagaaataatggccgggtgcagtggctcatgcctgtaatcccagcactttgggaggccgaggcgggtggatcacctgaggtcaggagtttgagaccagcctggccaacatggcaaagtcctgtctctactaaaaatgcaaaaaattagccgggcgtggtggtgcacgcctataatcccagctacttgggaggctgaggcaggagaattgtttgaacccgggagcagaggttgcaatgagctgagatcatgccattgcactccagcctgggtgacagagcgagactctcaaacaaaaaataaaataaaatctaaactattctcacacgcaccatctccttagggcactgaaacattactgtgggcttggcagggcaaaactcaagagtccccactttactgatgagtaaatgtccccagggaggttattggttaggaagtggcggagtccagattagatgctagatcttcagtctcacgtttcggtgctttttccaccacaggggtagatgaggcaggaaagtggaacacaagggaaaaaattcatccaaatgaaagctgtttgttagaaatatgtctttttgaaaaattatgttttaaaatgccaacaacaggggcaggtaaataggaaagtgcatggctctgaaacaaacctaagtagggaaaagctgagtgatcactcaaggcagctgactgcatttcttgctccagatctctgatgaattgatttcttaaagcagtggttcccaaagtgtgacagacaagtagcactggcatcacctgtctctcagaacgcccagtaagagtatttattcatgttatttatttattttgtttttgtttttgtttttttctttttctttcttttctttacttttttttttttttttttttttttgagacaggatcttgttgtcgcccagacttgagtgcgcgatctcagctcactgcagtctcaacctcccgggctcaggtgttccttccacctcagtctctggagtagctgggactgcaggtgacatcaccacgcccaactaattttttaaattttttgtagagatggggtctcgctatattgcccagggtggtctcgaattcctgggctcaagtgatgctcccaccttgcttcccaaagttctgggattacagatgtgagccaccacgccctgctcatgttactgaataatcaccttgatagcactcaccatgtgccagccactgttctaagcccttacaaatggctaattcatttaaagcccactctataaccccttgaaaaaggcactattatcagcttattttacaggtgaggaaattgaggcacagaggagttaagcaacttgccttcggtcaaataattaagaggttgcagagttacaattcaaattcaggccatctggctccaaagcttgtatgttggacctctatactatggtgccttttcacattcttaacctctctgctatgctaggctcagttgcttggtagttgtgaatctgtagattaaaaataaagatggaatccataattgtgagaatcaatgttgttctggatcacccaggtggttcataggcaccgcctcctccaatagctttggactggggcaggggttcttttagttcaggatggctcaggcctggtttttgaaggccaaggggactgacctgccacttctccactgggttatcaattgtgcgataatgattgcctgctgtgtgcccagcagtactggctgctgagaacatcgtctctgactccagggaattcacactgcagttggagggccgtgactatgacgcatgagaacaatacaaactataagtcttaaagtatgagtcagcgctatagggcactcacatatggcctgtggccagatctgtggattagtctaattcgatgctaagccacctatagcagatgctattggtgccctgcctatacccccttggcccaccccaggggtcacctgcagacagttcctgtggatgcttacggctttcatgtctccctgaggatcatctatgtccatgggagtgtgcttggcccatgtgcgggacaaaccagaagtgccagggagataacacccccaaacagtgagtaatgggagttggtatttaaatatgccagcttccttgtcccttggtgggaccacactcagatgtgttctatgttatctcccagagttccccagttgcattgtaccccataatactcatctgctcatgaatgtgcccatttccggattcacccccttgtctgtctcacttgcatattcccccactctgcttctggggaccctccctattgggaaactccccttccaaagttgaggccaaatcttactacctctagaaaacctgccctgacctcggaagaattaaatccccctccccagtgcttgcttctctttatccatccatacctggggatatcactttgtgtcacactcattacgggcttcctttgtactgtgagtccttgcagtgtgcggtcagtgccagacaaaaggttggcgaggcgggtggcgaactcacgggagggaagctgatgggcactgagagcctgctcagggccactcttccaggtgctttacgcacattatctcatttaatccttacaaaacctctttccggtgggtagttttcatctcggtttacagacaaagaaactgtcaaacaaatgaaggcatttgcctagaggtcccacagctaggaagattccccatcagaatctgtagcctgtactactcacacgacaccaggctgcccagggcaccctcagtaagtgtctggggactgaatgagcatgtcactgaggtgcagggctaggggagtggagagggagcctggggtgagctgttagagagcagcagctcccccgacccggggctctgggagatctggaccgtaaacacagtagcttcaccctggaagcctgagaggtgactcagtagctcttgacggcagggagaggtgggatgacactctctcgtcaggccactagccaacagagagagcccgtggaccttaacactttcagttgtgtgatttggtgacatttgaggggctcattcttggtctaccagaatgggttttggcacctccagcctccagctctcctgggcggtaccaatgcctttttttttttttttaaatctttgaaggaggtcttcttttagatacaactattctattttccagaggggcagatgacataatagtggaagatggttataatttcattcttgcagagttgtcttcctcatttggaaacaattacacatttgagccagtttggtgatctcatgagctacaatccccaactttctctctgggctgggtctagatctttctgtgctgcaggcatttccagcgatgagtccctctataattcccctctctgaggcctggctgtctgatttcctcctatcctctcttgctgtgttcacctgagtccttggtcttccttgcgaggaagtcggtagagctgcaggaaatgggctgcgtgctcctgagaggcgggaaacctgttctgtttcattttgtcctctaataccagaccctgtcctggtctcctcattctctctcaatcccctgtctgtacaaatgaggttataaatgcttaccatggcactgatctgatgctcagccaatctcacaacccccactgacccctgccaaatcttactacctgcacccaggcatgaggccatgtctgttggaccctggctctttccctagcaggtggaagtggtgatggggagtgatggagagtctatcatagataggttgcaggggaaactgaaagcagagggcattgtgtcccactctccacttggaactccaggtaaggactccttatgggccctgtgtgtcagcacagggcagttgcagagatgaagtggcaaaactgtttcctctgggagatgatgtcccctccaagtctctctcagctctcatgtggtagagtagggactctaaagtaccctcatgttcttagtgggtagctgtgatgagatccaggggtggggacagggctgcaaagactatggcatggacagcctaggccaggggtcagatggaggatgagacagacattcagtggtgagagctcaagggagctgtattagcaggagaaggaccccccaggcctggatgggattctgaagaatagaccatgggcccactggacacagccttcagcagtggacaccagttggatacccaggagccctgcaggatgagggaggtctctggagaggccattgagaactcagggctcagcactgggtgagctcacagatccaggccccttctccctgctgccagaaaggccctagcacgccattctcagcccaggcgccatcttgactaccagaaagaaaaggagggtggacaaagattgtgcatttattcacaagtcattgggttaactagagaccattttagagcaaaagagacaaagctaccttaaatcatcagacttaaggatctctttcctatatttctggagtggaggctctgaaacaaaagggagccaccctagatatcaaaggcagctcaggaatttttggtgtgttttggtgctattgtttctacatctaaattgtatctataaattttaaacttgctttaaaatgaatacatattgaacacagaatgatgtgtcagggcactccattaggaattgtgggaggccatcatcatatcttgaactctgatcctcctccaggttttatcttttcaggtatgtagagacatcattcaggtcctagagggtaatggtgacatcttttctctctttgtagcctccatattttctagcacatagtaagtactcagtaaactgtggttgtctaattggtttcgatttgtgaccctagtctaaagcctagagatattccaaaaagtgggccccccctcagcttacatcagcagtactatgctcatccgaacccagtcagttctgatacagtgtagactactccaaacttctgtatagacttcagtgaggtggctgtaccttggctaggattacccttgaagaatggatttcccctcctccatatgaggaaggagctcaactgattccccgttaagattccttcacagtctgacattctgtgagttcaatcagccagtagggaccatcttcagattcttcattcattgtcctggaataccagggatcctcgaacattatgtcattctggaagtccttgggtgatgtctgagctgctgattatttatgccaggttctcacatttgggtgcacattggaatcacctgggggaatttaagaacacctgcctcggccgggtgtggtggcttacacctgtaaacccagcactttgggaggccgagccacgtggatcatttgaggtcaggagtttgagaccagcctggccaacatggtgaaaccttgtctctactaaaaatacaaaaattagccgagtgtggtggtgggcacctgtaatcctagctattcaggagcctgaggcaggagaattgcttgaacctgggagcagaggttgcagtgagctgagattgcaccactgcactccagtctgggcaacagagcaagactccatctcaaagataaaaaaaaaaaaaaaaaagaatacctgcctcctacccccagagattctgacattattggtctgggggcacagcctggatattggggttcttcaaaataccccaagcgatgctagcagaaccgagaaccactcacctctgcaatcccattttaaggctgttctcctgttcaaagtcctaatgtgaaattggaaacaatttataagtcacattttttcgaactacatttattatgtgaggcaatttcaaaggcttttaaagttataacaaagccagtaatctcttgatttcaaaatggataaaagctctagaagtggctcttgccgactggcaaatcccccaagttatcgttgctgtccttgccttgctcttcattgaagaatcccagtgtctcttcatagtatcttatttatttatttatttatttttctgagacagagtctcgctgtgttgtccaggctggagtgcagtggcgcgatctcggatcactgcaacctccgcctcccggcttcaagcaattctcccacctcagcctcccgagtagctgggattacaggctcgcggcaccacgcctggctaatttttgaatttttagtagagacggggttttgccacgttggccaggctggtctcaaactcttgacctcaggtggtccacctacctcggcctcccaaagtgctgggattacaggcatgagccaccatgcctggccttcttcatagtgcctttagtaccagtactgtgtatactaagacagattctttagtactactacatagtactggtactaaagacagattctttagtactactacatagtactggtactaaagacagattctttagcactactacatagtactggtactaaagacagattctttagtactactacatagtactggtactaaagacagattctttagtactactacatagtactggtactaaagacagattctttagtactacttcatacatagtactggtactaaagattaacaacagcagcagcaacacaactggacactcctgtaggtctttgcggttgacgaagcaccttcgcatacatcatctcacggtgtccccttgaggttagtagaaaagtttgtgttatcctcactttgctgaagagaaaactgaagctcaaagcaatggagtgactttctaggttacccagaaagaaacagtaccaagatccagaaagtgcttatttttggcttggacagtttgggtaatttccaaattcacacagctggaaagtggaggtggtgagattctagaactcgtgttcttaaccacttccccaatatttagtcctgaagcattaaaaatggttttcttgttgttgctgttgttgttttagagcctgggtctcactgtgttgcccaggctggaatgcggtgcctattcacaggcgcaacaatcatggctcactgcagcctcgaactcctgggctcaagccatcctcccatctcgacctcccgagtagctgggattacaggtgcatgccaccgtgcctggcttgaaaatggtttttacacaactttgcatgatttgttcatcctgggatgaatttatatccccaaagcactgtataaagataaagagtgatctaaggcataaaagcaacagttctgctgatttaacctattagggtttaagttgatattccaagagaacacgctgttgaaatgcaccttaatagcattccttagttcaagaaataacaagaaacacattgatcttgccaagaggcctcacatttacaagatcacagggctgtaaaaaacatcaaggtaagttagagatacttttgcaatgatgtttgtgatgtgatgtgtgttagtctttaacatccgtgtccagtgtgacctatacccttttgttacttttcttttagaagtgaacagagcataaagtaaaagttactctaatgttgctatagtatttagtacagcatagagttttttaatttgaagaagagataaacaaagatataaaatggcagtaattttgctttagtgtgtaaattagaattgcttataattatctgattaattgaatgaacaggaattgaacacatagctctgttgtctttcaattatgtagacatttttgccttgctcctaacttgaaatatgatttgatattacacagattgggattcacagtgaagtctaaccaattctgggttttggtgtacacaagcagaaggagatgggtttgaattagtgagaagttttcagttacaggatgttttcaaagtagagttttaaaactttgaagtgagttgcataatatgactagaatgtaaactctctttgaggccagggactttgttttattccctgctataacccccgtgcctggcacacagtaggccttcaaaaatgggattaaaagaataaactttggcaaatgacttcacatttctgagcttgtgtttcctcacttgtggactgaaggggttggactattttggtatctggtattttccccacccatgacctattttgtaattcttttcttccagtgaactccaagccctaaaagatgcttttgcacaatttatttaagtaagattgttctcatttttggtgttgagtaaaaacatatatgacagtatccagtgtttgtgatcagcagtagaaaaccagtattgatataatcccaaacggtacaaacattatactctatttttattttatttttattttttagagacagggtcttgctctgtcaccaggctggaatgcaatggtgcaatcatagctcactgcagtctctaacacctgggctcaagcgcacctcccacctcagcctcccaagtagcttggactataggcatgcaccaccactcccagctaattttaacatgtttagtagcgatgaagtctcttcatgttgcccaggctggtctcaaacccctgggctcaaactcctgggcacctgcctcggcctcccaaagcactgggattacaggcgtgagtcatcgcacccagcctcagcctcacactctaatttttgtgtgtgcagcctattgtggataaataagcgatttttgaaatgatgaaagtaccgtctaaatgactacctttgcaaaacgtacagtattgcactaggtcatcttcaagtctcctttacctctgaagtggatttctatgaacttcagtttcctgatgtgtaatacgaagggatggaaccccatgatctttgtaggaggtgccttcctatgatgatcctaaactatggaaacttgaattagatgagcacagtgttctaacagacattctcactaacctagtgttagtgaataaataagaatgttttatagtcagaatggaaatctcatgcatgtaaatcctggaagaaaccatcttcatgattttttaaaatgccctctacaaattactgataccacattgtttgcattaagtgagaaaagtagtttattatataatggtaaactttatccaagggcacagaatcatatagtctgaattaataataattacaccttattgttgaaactgtgataaaatgcttgataaatgtaatataatttcattcaaagaaatcactcccattttacagataaggaaatacaagcagaggaatgttagaaacttactcaaggcagagccaggatctgaacccaagtcagtctccttaatcacatttaaggcttggctcagcaggcatgttcatttattcattagaaataaatgaacacagacattttattcatatgtaggagattaccaaatcagagttacagattattaaaagtgagggatctcagatcaaactttcaaagctcatgacaagccaaagaaaataggaggagaagacattattagaacaggagctaccaatgtataaaggctggctaaggattttctgaaggttaagggttaacgtggcttcaaaacagaggcaacttaaaaatacaatttttccaactaagtaggatttctatgcagcaggactatgcctaattccaaccctcttaatggttttttactagcatgtagttgtttatagaactagttcctcacataggagtcccactttcaagggtcccggagaaccacgatatgaacattcgctaggagcaaagctgatagggtgagtcataaagaaggggctgttcatattcagcctcaaagtggcaaggacttctcctcctcgggttcatgctgactgcctgacttttgaccttgtcaatatcatgacaaagaacaagagagaaaatggtggctggggagagtgattttagcattaatcttgtcccacccttagtttaatgggcattaattacttcacagcgctcaaattaaatctgatgtggcagagactggctggcaccaaagcttttactttttcttcctcagcacacagctaggctacatttcccaacctcccttgtagttagaagtggccgtgtaactgagtgctggccaatggatgtgggtataagtgatgtgtgccacctccaggcctggtcattaaaaatctcccacctggccaggtgcaatggctcacacctgtaatctcagcactttggaaggtcaaggagggtggatcacctgaggtcaggggttcgagaccagcctggccaacatggtgaaaccctgtctctactaaaaatacaaaacttagccaggcgtggtggtacaagtctgtaatcctggctacttgggagactgaggcaggagaatcacttgaacctgggaggcggaggttgcagtgatccgatattgtgccactgcactccagcctgggtgacagagtgagagagactccatctcaaaaaaaaaaaaaaaaatctcccacctgattcccatcactctctctctttccccgtttgcctgccgcatcgtgctctccagagcaaacttggaatctgcatctgacacatggtgagaactcagtaaatactagtaattatcactatagaccagtgctcatagaacatttttttgcaataacggaagtgctctatatctgtgctgcccaaaacagtggccaccagccacatgtgaccacagtattgagcacttgaaacttgactggggtactaaattctaattatgtttaactttaattaatttaaatttaaatagccacatgtagctaatggctaccatgttggacagcacagttatagaccatttaatctaattgcttcagaaggtttctatctcaaactgtgtaagtcaggattcaatcacaggagaaccactaaggtgcgtgcacgcgcgtgcgcgcgcacacacacacacatacacacacacacacacacacacacacacacaaagggatttgctacagggatttgtcctaatacaactgtgggagctggttaagcagtctctataaagctctcatcttcacatctgatgttgggactcgacatctatcggacaggcagttgggaaggaaggataaatgtaaaataagggagagcaagaacaacctggaaaccagaagcatgcattgtagcccacgagaacagactgagccccacgtcgcttattgttgcttttgaccttggcagtatggatatcctgcagaagctgggcgcttcatcataaagtacacacatggccaaggagccgaagaagctgaaaaggaaaacccaggagaaggtggagcagttacaggccccgcacctccctggtcctaataagatgaggcaactgatcattgccaacctatgtgagctacaacatggctgctgcccacatctgcccagatctcccacaggaaactctcttctgtcccacgttaattagaaacatgcaagaaagggaattttgggaaatgtagttggtctaacgaagatgatgcattatggagccaccacacatgctagcatgctaatgagctcaattttctatctgctaatacttctaaataaaacatgaagctaacatctcccaaggctctgttttgttgtttcagttctgcaactggcctagagaattctgaagatccttgcagccagctaacgttatctttgagtggtaagattaggagtacttttcaagtttttccttatatttttctgtggcttagaattcttcccacataaacccacattatgattgtaatcagaaaaaaattagttactttttagaagccagcctgtgacccctagggagaccatgcatcccacttaagggcaacccaataacatcatgattaactgtgtcttctacattcttcctggaaatttcacctgttcttgactttgtacaagaacttataaaacgtaagttatggtcatcagatttcctgaagccctctgcttctctcctcccatgttctcaaagtgatcccaaggatattttagaaactggaagcaaataatataaggagaaaagaaactggagtggaagtcttgcacgtagaagggagaaatcatttttagataagtcactgggaaagtgaagaatagagagcgcatccttgatatggtttggctgtattcccacccaaatctcatcttgaattgcagctcccataattcttacatgttgtaggagggacccggtgggagataattgaataacgggagcggtttcccccatactgttcttgtggtagcaaataagtttcatgagatctgatgtttttataagagatttccccctttcacttggctctctcttttgcccgctgccatataagacatccctttgctcttccttcctcttccaccatgattgtgaggcctccccagccatgtggaaatgtgagtaaattaaacctctttcctttataaattacccagtcttgggtatgtctttatcagagcgtgaaaacggactaatacagtcattgtattaactactgacttgagcagtatttactgtgtattcttctcaatactttaacagtagtacctatgaagtatgtcctgttacacttatcttcgtgcctgtttttcacctgggaaactgaagtgcagatgggttaagtaagtggtcaaagttacatagttagcaaatggcagagccaggatttggacctaggccgtcctggtctttggagtctaggctcttaacctacctgccacactgccttctttaggggtgcaggacagggtcacgtggactatgggagttcgatagattaactgctggcaggccgattcctgtttcttcctcactcccacatcccagtgaccccccctccgccccgcaaaatcctctcacttttaccttagtaggatctgttgaacctctcttttcatgccagcttcccaagcatgggttcaagtcctcatcgtgtcttgcccaatgtacccctgtagcttactctctggccttcccacttcagatttccttcatttatttcatagttatacaaaaaatattgttctgtgtcaggaacaggggcaagggggaagggagaatggggagttattgtttaataggtatggggttttggtttgggaagatgcagaagttctaaaaagagaaggtggtgatggttgcataaacatgtggacatacttaatgcaaccaaactgtacacttaaaaatggttaagatgaggccgggtgcagtggctcatgcctgtaatcccagcactttgggaggccgaggcaagcggatcacctgaggtcaggagttcgaaactagcctggccaatatggtgaaaccctgtctctactaaaaatacaaaaattagctgagctgagcatggtggtgggcgcctgtaatcccagctactagggaggctgaggcatgagaattgtttgaacctgggaggtgtaggttgcagtgagccgagatcgtgtcactgcactccagccagggcaacagaatgagactccatcttggaaaaaaaaaaggttaagatggtaaattttatgtgttgtatatacatatgtatatatatataaacgtatatatgtgtttatatatagacataaaaacatatgtatatatgtagcatataatttgtggttttatatatataaataatatataataaatataaaaataataattgttctgaaatgtaccttaaaaagcctctactgcatctccttctccacaagataaagcccacatttcttagcatagctttcattacttgatcatctggctcatgtgccatgcaggactgtagcttggccaccatctttttgtgccgatgactttgtgatcaaccactcctctttggcccttctcctggaaagaccccatagaactgagagctatcattcagccttgccgattatcatggaagtagcaggaatgatgggttaataaggagatagacttacagacagcctctcaggtggccagacagcatagagtgaatggagatggtatggcttagtgaaagaggtatgggctctcaagtcaaacaagtctgagtctgagttcaggcttaccattaaactctccatctgtgaaatgaggatgatcgtttcctattgtagggctattgtgaggattattagcaatcatgccccagatatagtgggtattcaatataagatatacagtgtgaattctctttagctcagactcagttaactaagtttggaaagaaagacatgggtggtattccagttatctatttctgtgtagcttaatacaactgtcatttagtttgctcacagatctgtaatttgggcagagctcagcaggagggctcattcctagttcacatggaatcaactggggcatcttggctgagggctggatcctctgcttccaggatggcctgtgcacacatctggcaagttattgctggctgttggctgggagctcagtggaagctgaggactaggaacctcagttcccatgtggcctctctacatggcctgagttctaaggataagagagagggagaaagagagagagtgagagcaagcaggcagaagctctgttgccttttgtcacctatcctctgaagcccatagtgttacttgcaccatattctcttagtcaaagcccacccaggatcaagagaaagggacataggttctacctcttgacagaagagtggcaaagttctggaagaacttgtgagatgagaaatattgctgtggccattcatggaaaatgcagtctgccaccaggagttttcagcttctaccttaaggctttggacttggaacccatagggaagtgatttctgaggtttacagagtgtcatggggccgggcgcggtggctcacacctataatcccagcactttggaaggccgaggcgggctgatcacgaggtcaggagatcgagaccatcctggctaacacggtgaaaccctgtctctactaaaaatacaaaaaattagccgggcgtggtggtgggtgcctgtagtcccagctattcaggaggccgaggcaggagaatggtgtgaaccaggaaggcggagcttgcagtgagccgagatcgcgccactgcagtccggcctgggcgaaagagcgagactctgtctcaaaacaaaaagagtgtcatgggcaccatgtgcgacatggaaccaggaggtgggggacatgagttttaatcgtatcaccacgcagcagtctcctcttacacaaagcactcacctggagccctggacttgtcatttgtaaccagatgatgccctcttcagctttactcttctccagttctctgagactgtgaggtccgggcactgtccattccaactccgacatgtcagccatggctgaatcagtgcttctccatccatcttcttttcacatcggaattgctagaggagctgtcaaaaatgcagatgcccaggttgaaatgatcaggggtgggatctggacatcagtcatttaatttaaaaaaaatttttttagagatgggttcttgctgcgttgcccaggctggtctcaaactcctggcctcaagtgatcctcctacctaagcctcctgagtagctgggatttgaggtgctagccaccacgactgactacatcagtaatttccctgggggtgatattaatgtgcagccagggttgagaatcggtgagctccgccattgtgtccatctaagtgtgtacaggagtcaatcaaaggaacccaagtgtagccattgcttttcgtgcccctgtgacatccttttgagccatctatgagaccagccacagaagaggtggacagttctatgctcgcagacttctgtctgcctctggggtttcccccgagccctggcagcctgctcagctgtcacaggaagagcccaggagtgcagaggaagtaatggcccaggagcaaatgtcaactgttggggagggagacttggataaatgccccagtctccagcccttcctagagacaattctagaaggcattctctatgcttctcagaggtctctttggacttgagctcccactgtccacaacaaacaccccaaacttggcttccatccttccctgtctctttctccctgcctcctgggattacctcccaaagaaagtacttgcactccagtcttgatcttaggccctgcgacccagagaacctaaactaagatgccaagtgatcactgctcaattgtgaactggcaaagagtggtgtgaactaagggaaattggaaaaactgctcgccacagccaaaccactggtgcacgcacccctgccacctttccaggcacttctgcacttaaaactcccacaagcgactcttgctaacccatacatgacagatgctttgatgagaaggaaagtgtcagctggctagcagcagaatcactctagacactagtggagttggggaggagagggttctttcttcacactctatcttttctggaggaagcagagataaccctacagcaggggtgtccaatcttttggcttccccgggccacattagaataagaagaattgtcttgggccacacgtaaaatacactaacatgatagctgatgagctaaaaaaaaaaaaatcacaaaaaaatctcatagtgtttcaagaaagtttatgaatttgtattgggccacatgtggcctgtgggctgcgggttggagaagcttgcctaggtcatgcattctcagtggaggcgctatcatccccattggggtggaaaattggttcttggtagcaaaacaacaacaacaaaaaaaaaaaaaaaaaaacacaaaaaacgcttatatatgacacagggccaggactaggatgaggcaagtcaggggcccagggaagaaaatattaaggagacagccactcccagggctgtggatgtccgcatatggataaacatattaactcgccagatggcaacgagcctgtgcataaagagatgaaaaggatcaggcagaggcagaaagtgttgcagtttgaaatagactggtctggaacagcctctcggagaaggtgacatttcagtaaaatgtgtaggaggctctgtagcaaaccaaggggccttctgggggaaaagtgttccaggcaggtggaacagcaaaggcaaaggccctgaggtgggaatatgcttggtgtgttggagaaacggcagggaggccaggatggctgagtgaggggagggcaggagaagataaggttggggtagagagctgtctgtttcatggaaatgttggggcgattccattgagtgaggagcacaggtataaggccagtgtcatcagtgtccaataaaggtgagtcggcctcccgctttccccactcccaaagcgctaagcagcatttacatgtcgtcagactgaaatagctctagaagctaccagccttcggaagttacaccaatcacttcggaagtgaacagaaatcatggctagcattctaaatgaaaagcacagccatgacgctccattatcagcacgggccaggaccagcagcgtagattgctagccatgtgtctagtttcagaggcactgggaagggcggggaatgatcccccagtatcctctactggtcagaaagttaatttcaaggctctcattcttcctaaagtacacatccctcctggtggagcacggtggacacccagtaggtcagtggcccttccttctcttcagcccacagcccaagatgagaagcggcctggtgtagtgaagctggagagcctgcctcacatcctagtctgcccttttacatgtaatcttgggcaagttacttgactgctcttttcctccatttccctatctgtgaaatggggataacgtacctcatagggttgttatgagggctaaatgagctaatatttacgcagtgcccggtcatatagtaatgctgtataagtgcttgttaattaaagatagaccccctttgggggctctaatcttcccaggaaaaaatgcatatgaacacacatttgcattttatttcggggcatttatggacgctccaaaatgcatctcgtggacccttggggaagggacagttcataaagccctgagagaaccaggatgagttctggagggatcaagagccagggggatgggtgggcgatactgtgcgaaggcaggagaaaagcaagaattgggggctgggggctcaagaacacatttcaccttcttcccgttctggccaaagcccacctagaactgcggattgcttgcactttgggaagttccatcagctaagagccgaagttttttttaatgatgtcattattaatcatttaataaatacattatgtaagagtacttattgagcagtgtcccagcgcgagtaaacatgttttggatatgccaaattagaaatgttttcattcagttttgggggttatgtagtaaactcggaaaatgccgttcctggaagagtgtctgttatcccaagcccttaagagccagtgtaataacaacaaaaatattgttctgtttggggttcccatataagagtgcctaggcgtggtggcttgtttttaattatctctctatggaacagtaattcaatccagaggaggactgccaccagattacaagtttcagttgggttgaaaatattcatgcaaggagagctagttgtaatctttttagatccactcccaaaagattaagcctttttctttcccatccaacttggggaagaatgtggtggaagtaaatactcatagtagtaccacaatcataggtgtaagacaaccatctcacatttgaagtcttaatatctaccacggtgtcaaatagcagggagaaaaatgaacacttcagaaacacccagacatgatcttgcataactttggtgcaggtagtttatttgggaggtgatcccaggaatcaggagtgaaggagcaggcattaggaaaagagagaagggagaaggcattaagaaaagaggaaaagtcattaacaggtatgttattgaggtcaccactgtaggcaatgggggctcacaatggctgactttttaatgctgtttttgatatgtatttgggtggacattttagcatacatttgtaagacctgttaaggcatctatctgctgtgatcggcagctataactactcctccaaactttgaaatctgagtcatagtcatccaagaagtattcttgagtctttgctctgttgactctgcattagtcattttgccttgttactttcagatccattccccatccttcccttactctgtatcacagggacctgaccccttgcaatatctttcatgtctccttgccaactggcttccagctaggttcggccagtgggtgtcagtgacaggagattggagtgcaagaggaaaggggaagtcagggtatttctccccctctctcggtttggctggcatctctaatgggggctgtgcctcttccatgattccagtctcactggacagaccccttccaacatcccgtggcctgaactcctgccttgtggctctgttcatcggtatctggtaatattacctcccccctttgctcttccagaatcttcctgctgttgctcacctctggattgctccagttcttcatctttgcaacatttccctgtgttacattcctgctcttgaactacctgtcatgggttcccaactgatctctgactgacggagatttcttaaggatttcattagtcattgcaaaaatattttaggacatcaaccacaaacaagacactggactagattcctggaaggtaataaataaagcatcaagcagcttagcgtctagttgggtaaacaaggcacacagtggaaaagttaaatgacatctttccaaatgccaagtgaaagaagggcgtagtcaatgaatacttgaagatataaagaggagagagccagctccatcagcttttgtaaccagggcatgctttagagggccagggagccgacataaaggggtcatctcccaaaacttacaattttgtaaaacaaggtgaaaaattggaattttatttgaaatttcctgatttttaaatgttggtgagtaattcaaattttcagtaacttggagctgggcatggtgccacacctctgtagtcccagctactcaggaggctaaggcaggaggatcacttgagcccaggagcttgaaacccccatttctgaaaaaattttttaaaaatatccaggtgtagtggtatgtgcctatagtcccagctactcaggaggctgatgtgggaggatcccttgagcccatgagtgggaggctgcagtgagctatgattgtgccactgcactccagcctgggcaacagagcaagaccctgtcactaaaagaataataataacaaaaaactccagcatgattcccactatgtagacaagataaaacttgtttggaggctgaattgagactgtgggtgtacaattggtggatggattactgtatgggggaagaaatgggatgcagagaatgttaggattccttccaattagaaggttctaaggttctaattttacacccgggtatgaggcagtgacggcctgggtatggaagggggcagtgagcatggggagaagggacagatgagagagagattaaagaagattaataataaaaccctatggccaggcgcggtggctcacacctgtaattgcagcactttgggaggccaaggcaggcggatcacttgaggtcaggagttccagaccagcctggccaacatggtgaaaccccgtctctactaaaaataccaaaattagccaggcgtggtggcaggttcctgtaatcccagctactcgggaggctgaggcaggagaatcacttgaacccgggaggaggagcttgcagtgagccgagattgcgccactgcactccagcctgggcgacagagcgagactctgtctcaaaataataataataataataataataataacaacaccccccatttctgtattcgattatggtctacagagtttgtcattggaactgggatagagtagagcctcagaggttaggctcagaagtcaaactgccttcgttcaaatctcaggtctacaagcaatgatctgtgaggccttgaacaagtttctaaacctcacccatcctgtttctcaagcactaacaaggaatgatgttaatgatatcacctacctcttcagggtcgaggagtccttctcatggcataactctgacccactcttctgcctgcctcttccacttttaagaactcatggactagattgggcccacccaggtaatccaggataatcgatccatctcaggatcctcagtgttcatcacatttgcaaagttgttggctgattaaataataaagtatgtttgaagtccttcatgtggtaagcctggatcacaggaagcgtggatcagtttttgctattcctgttatgccatgtacattctctctttgagaatccttgcaacagccccatgctacaatgagaagactgcccaggatgcaatgactggatatggaggtgggagttggggatggggaggagtcaggagcaatggccagagagttagcatcttggtttgtagactcgactctattgttaaaagtaactctttgtttctgggctcttcacttgacccctgtaggattttctctcttgaagggcggttccttgcaactcattctccataatttaggaaactgggtttctgagtatggtggaaagactgatggctccccaaaaatgtccacatcctaaaatccctggaacctgtaaatatgttaccttacatagcaaagggaactttgcaggtgtgattaaaatgaaagaccatgagattatcgtggactacttgggtgggcctaatagctcttaaaagtgaagaggagtcagagtgatgccacctgagaaagacctggccctgtcccatcatggctgactttgaagatagaggaatggggcatgagccaagaaatgtggggggcttctagactctgggaattgaaggaatggccctcaatgtattgctagcaagaaaatgaggaccttggtcctacaaccacaaggatctgaattctgcttatcctgaataagcaggaaatggattctcccctagagtttccagaaaagaatgtggcctagcatcatcagcattgattttaatctggtgagactcctactggacgtctgacatgcagaactctaagataacaattttgtgtttgaagccagtaagttaatggtacagcagcaacagcaaaccagtactgaagttttcaacttaaatgtttggcgggtgttactggcaatacttttgagttcaggaactgatcaagggtggaaatgatgtggggtgatgagggatgagttcttggatatactgagttggagaagcaatgacagcaagacattcacatggcagtgctcgaaccacacttggccatgtgggattagagtttagaaggtagtggcaataactgaaaaaaaaaaaatgcctgggaggggatgtagggaaagagactccattgatggggccagtttcttgagtttccagttcgtctggctccatttggcttctattctaagccaaactcctgctcatcctaattggaatatatggactttgttttaaaaaaatcactagggagtcatactgagtaaattttatagacacggcaccataattttatttattgacttaaattgagacttccataaatgaataatgcttgaaaattggctctttgtaggttccaaaggaaaatctgaaaattttaaatgtttttcctttctttgtttatgaatctttttaacaatggaaatgttttgtctcctaagagtggcatggagctcaaatatatgactcactggatatgacgaccacctctttaagttgtaacaaatgggaagtgagttaggagagggcccaagagaaacataagctgatcctcagaaaagtgtaagtcctgtggggatacctctaggttggaccaggagtgaggtggagcatcataatgagagacagaaaaagtgaataaatgttagtgactgagcagctgggttcctaaaggaaaaagaaatgccaaaagaaaaaagcagagaagaatcatttaaaaatctctagctttaatttactagattccctcccttcatcaaagtagaccgctgtctttcctgtcaggagttactgagagccctgtacatttcatgatgaaagagaccagccctgggctggtccaacccctcatctactttttttttttgaaacagagtttggctccgtcgcccaggctggagtgcagtggtgtgatctcagctcactgcaacctccgcctcctgggttcaagcagttctcatgcctccgcctcccaagtagctgggattgcagatgtgcaccaccacgcctggctaatttttatatttttagtagagacggggtttcgccatgttggccaggctggtctcgaactcctggcctcaagtgatcctcccacctcggcctcctaaaatgctgggattatagatgtgagccactgcgcccagccttatctacattttgatcaagtttcagctcttgattataagcccacgcctatcaaactcagggatggaggaccagttttgtgagtttcccagaaaacttccttctctgctctggctcttctcttacccttgacttgtccatttttttctaataagtaagaaagaggtgaaactcaaatcagccccctgtgtgtacacagctgtggtcaacagatttggcagtggagaaggttggaactatggccatccaccgggcaaaattgtcagtgaagcaatgttagcctctgttgcccctcgacgtcactctccatccctcttctctggtacctaactcttcccaggtgccttcatcctgctccccgcctttgccaggtgcctgcccttcttcactttacctgcccacactgacaggtgtcattctgagggtagtccatattgaatgttgattttacccagggctttcccacgttgcccagtgtggtagctctttgctagatgatcagatgaattcacccaattcaaatgaactcatactaagatgtgaatgactgatgaccccttcagtgttcccaaaggtattttttcaattaaccctttcaggctgggcatggtggctcacacctgtaatcccagcactttgggaggccgaggtgagtgcttgagcctcaggagttcaagaccagccctggcaacatagtgagacccccatctccacaaaaaataaaataaaaaaattagccaggtgtggtggtgcgtacctatggtcccagctattcaagaggctgaggtgggaggatcacttgagcctgggatgtctgaggctgcagtgagccacaaccgcaccactgcactccagcctgggcaacagagtgagaccctgtctcaaaaacaaaattaaccctttaaaagctaactcaacagattagtggaatattaaagtagcatgagagatacagaagaacagagactaaggaagaagtaactgcaattaaattagggcaccaaagcacctagccacttgcctacatttgccttgttggctgcagggttattggggaacttgggcactcattcagtcctgctttcgagccgaactatgattttaattatcccagaaaacaatcagtaccctaccatcatttcaagaaaataggctcctggaggctaccaggtatgtttcactgtgcaatgttagtttgcaaacatacttattctttcctattaattgtatctcaagataacattgtaaaaatatccctttgtaattaatttttttaatgtataagataacaccccatgtgggtcagtatttggggatgtaacacttctaaagggtagtataaattggtccaagttttctctagggcattttgcaaacaacatttatggaatttctgaaagaaatagccacatatgtatgtaaaaatttagcccaaaggatttattgcagcattgtttgtaatcatgaaaaatcatacacaccaaaatgcccattaagaggaaatttgttatatagataaatagtacatacaacaattgaagtgctattcagccatcatagatggtgttgtggaaaattgtttgatgatatagaatgacgttcatgatatattgtcatgagaaaaatcaagttataaatatttttgtgtgatataatccttatacatacatatatatacatataaacatatatgcatgtatctgtatatatgtaaatatatacacatataaacacatgcatatatctatatatgtaaatatatatacacacatagagaaataatatatactaacatgttaatgtcatttttctctgagtggtgaaattatagatggtttttattttcttcttcttgcttatctgtaatttctcgtttctccaatatgtatgtattattttcatagatagaaatatagaattacttttcttttaagagatctgagcattttccccaaataaataactcagcagctcttgtagtttataaacccagaggtgtctgatctagcttaactcataagaaagaaatggcttaatagatataacgtctgtgctcaaaagcagcacagttaatggaagtttaatttatgcaaacatacacgttaaaaagtattgattaggctgttgaaaataatagtaaattaacatactgccctcttttggtagctatttgtaattcagcttacgttcacttccattaaagatgttaatctcctacaaatgtgtgcataaattaaactaattttatcttattttttaaaataaattttattgtgcacatttgaggtttataacatgatgggatggagtacatatggatagtgaaattgttacagtagtgaggctgataaacattcacatacttttttttagtgacatgagtagctgaaacctacttatttgacaaaaaatccttaatatagtacaattttattgattttagtcctcatgaaactaattctgaatcacctcttttcctcaacagaagatactgataattccagtttgtcaccaccacctggtaagttgtttttttagaactctggggaatttcaggaaaatattattctgtaagttctctatgaaacatggcatgtagtcaggtacaacaaaattgttttcctccaagaagcttaattaggtcattaagcctacacctgaaaaatcaatgcaagcatagaccagaggacagtcatattgatccgtccatattgcgggacaaagccaggcaacaaatcacaggggactaaattgttagttttcattacagtaattacttaagttcagcagttatttttagtattctagttcacaagtctcttgaagagtatcaggaacataaacatgccagatgtttttacatttaagggaggagatgagatgagatgttcacttaaatatacaccctcagtacctccactgaaaggatatttttcactaggattctaagggcccagcactcaccagaatgggaaggcaaatacattagaacccagattggcaagtgcctggaacagaacctgaattcgagactgctagctggaatgggaccttagggataaagtgacccagccctgtccattagttgatgagataatgaagcctggagtggctgaggaacttctctaagatcacacagctccttgctccacatcacacagaggcagcacatggcttctctgactcctacttctgtattcttttgggtacaccatctattccagaacaatcttttatgatggggagtgagtcaactcacattctttctgtagttgtgtgcaaatgagcttctactgttattgattcattatttaaatccaattaatcacaatagctatacttctcatgcactactatgtatctggaagccttcagacatctcctcgttctcctctcagtcttgcagcataggaaatattcgtgttatagatgaggaaactggggcttggggaggataaaacatgctcgtgttcacacattctctggagccagatgacttgagttgtaatttggccaccaccttcctgccttcattcctagctgtgtggttttgggctagttcctttaacctttccatgcctcagtttcctctcctgtaaattagggagaataatagtagctgttgtcgggtagttgtgaagacggaatgagataacatatgtgccaggcacagtgtaaacccttggtaagtggtaactattatttttacgagtttttgagtaatggggcaaagattcaaacccaggactgcaggcctccaaagtccaagctcttttgatctcgccaatttgccccctagttgttaagcttctagggcacaatgaaccactatatttttcttccaatagaatagtccttagcaaactgaatcatggtgatatctgcaaaaccttgtttgcatagaatagggaatgggactctggggggacacactgggtctagtcacagcctggcttctgggtgccctgggggagagcagtgcaaactggaaggtaagagccagtgtagcatcaagggatggatgggcagccatgcccagaggtctcttctttgcacagtgtcaccattcatcaacattcggaagaattaatagtcattccttaaaaactagttgtggccaattattttgttctgccccaagagcaaaaaggattctatatctacactttgaatcttattgctcaggaactgtcttacttctcaagaaatatccttggtaatttaagaaataaataaatgtagtaaatgacaaaatatggaaacaataatgtggacagacagggtgtgtgtgtttcagccaacacaagagcagtctaaagcaggccagccaaagtgccttgacacacccaactttggtccataccagctgaaaatcaggctccatactgcaaaacttattttagttataaaatgttggtgtttgcttttcccatgtttaggtagaggtcaagccattgaatcttttaaatatttaaatatgcaaaatgtgtgtagtagattgacttcttagcttaagtggagtcattccacaggaaatttatcacttgattaattgccttaatagcagccatattttaaaataacttaccaggaaatctggttaggtagtacagtattgagtggtagcaatttttttaatcctaaatttactgtgggaagatttgctaggcatcactgtaacagaatggcaccagcgtgccaatatatttcatgattgtaattcggcaagttatttaaaatgttttctagaatgctctggctgaaaaatttttaaagtagtatttcttgtattttggtctggttcctaatcttatttctataatattccataagtagttagcaagctttgcaatcacgggtctcaggttcactcatcttgggttcttttcctacaattctctgattaaattttatactcactgagcgcttatgggacatgcagatttaactacaacttggtctgctagtgtgttttctacttcttttcgtaattatatctcaaaagttttaattctttaaaatttgacaaataatcgtttcaaaatattgatttaatttttttttctcctgcagctaaattatctgttgtcagttttgccccctcctccaatggtactccaggcaagattttgaaaaaatttaaacctagatttagtccaatttgttaaagttttgttttaattatatctttgtattgtttttctcctcgggacaaaaagaggttgaaacaacaagcctcaatggtaagaatttttctgaagcaagtgaaaattgataacccttaatatgaatataagtataatgaatggtgttgaaggtttccatttctaaattatttctgaatacgtcgagtagtttcaaataacccaaaacaaaacttgccaaccctggagagtgacctaaactttctggttaaatgataacattcttacagtcatggagggaagagagcagtccaccactctaattgttagctaaaaataaaagaaatatcgatcacattttgaattatccattcccttgctgtccaacacaatgccaacaagttttacatgacagattgtttaaatgtgaaaagcacatccagttattcaatatgattcagcatggatttggaggcacagtgtgttcaaagacagcctttttacagatgatttgatcaatttttaaatagtatgaaatgggaaaaaaatggcttccctatcatgctagagaaaagggcaaagaagtgggctttattcaagggaagggggcagagcagtacattctgttccctccaataagtgaacagaatgggtagacagccttccttccatcttattgcgatgaaaccccaacacttttcacaagcccttggttaaaatcaaatctcaccatatggttggtggctaaggagctaaacaatcatagatgcagcttatactgatcaaaactggtttaaattcatatttggcccaatgggaagggacagatgttatcatttttatgtgcagttacttctcacagtgaaaataatatcttcaatttagctttggtgcagtttttggatcccattttgtgtgtgtgtgtgtgtgtgtgtgtgtgtgtgtgtgttttaagtatgatgtaataaatgccttttggttttttcctaaaatttcatccagaatcataaattctagaatgatttggatttaaagaaatgccaatagaatcgattttaaattggattttaaatcaaacaggatccaaatgagattttcttaaaagttagtcgaatataatggtcatttactccaaatttaagctagaattattttaaattgctttataagagtgtaccactggtaaaaatgtattatgcatccacagggctatatattaaaatcagtattaatgttggaaatgtcatatcccttagggacgttcattataatagagaaaaaagggacaaaatattaaacaacatagatgagtttattcaaatctaatggttacgggagtgttgctaagtgtttagacatgtaacttgcatttgaatcaatgaacatttgctccggaattgtctccaggggttggagaatggagtagtgagaggatgggtagcaaaaacatttagtagtgtcagttggcttttgcaaaactaacttctcccagatttggggaaaagggaaatgtttaaggaacctaggaagacacacatgtttgtaaaccatgccagtagttatgctaatttttattattttatttcagatgttactttaagcttactcccttcaaacgaaacaggtaatatcaagtgatttctaaatgtaatagcttcttctgcagcctcttgagtgtcttgcttgtgcagtctactgggttactaaagagttttcttttgcctccttgccctttttcctgtgccttcaaccattgatttatgacccctttgactttgacattgaactataattctgtcaccacactcccaaacttccaaaggatggccatagcactccatttaaaatagcatgtattatttttgtgattataatagtgatacatattagctcataaagatggagaatatagagaaatgcaaagaagaaaatacaaatcatctttaatgttactttcctaagactatgactgttaacaatttggtctatttccattcagtatcatttatacatatatttatatacatatactcttatatcctttgcaaaatagtcataatttacatagatttttgtatcttgcccatttgacttaatattacgttagaagtatattccagtgtcccttactattatgacttgataatattccattttgtaccatatgttgaactttaaagttgtttctatctttttaatagaagttattgcaatgaacattctggtgccaacatctttgcattcatttcttatttctgtaagatacattctaaggattgcagtatgcaaggattgcattctaagggtcagcagtatgaatattgtaagactcttgatactactgcttggttaccttctagaaaggtcgtgcctagcgacattcctgtccgcagtggatgagaatgtctgtcactgtacctttgctgagactgtatcatatcttattaaatctttctctcaacgcttaggttttatttttcattcatgattactagtgaagttaaacatttttaccccagagcactttagttaccaaaaccagaagttcatttcacagttgtattttgtttgctctgaaaaggaaactatcagggcaaacaaaataatatatttaaaagatttttttttttttgagacggagtctctctctgtcatccaggctggagtgcagtggcgccttcttggctcactgcaagctccgcctcccgggttcacgccattctcctgccttagcctcccgagtagctgggactacaggtgcccgccaccacgcctggctaattttttgtatttttagtagagatggggtttcactgtgttagccaggatagtctcgatctcctgaccttgtgatccgcccgcctcagcctcccaaagtgctgggattacaggcgtgagccacggcacccggacctaaaagattcttaatgacaatgtgaaatgctatcagccttcataattaccacccatcattggctcatgggtcacacattgaaacctgacagtttcagaaacctcatttgtgtgtctttgttactgatgagtttctgccaggataacatcatcattcttaagtgtgtttccaatctctgagcttggccttttcttcagaatttgcccatccaccctaggtgacagagcttcggtgaaaatctatgccctgaacacagcctctttccattggccatttttacagcaaagatttctgtacctgcttctccgttacctggggaatgaaccatgggctctgtccccaaaacgtgtttggaagacatttctaaagtttgcttcttcagggcatgttaatatttgcctgtgagtcactcactttgaacagtcttggttctgctgtgggcgtgttatgtgattgtgtataggtggatgatctcgacctctctgagaatagcattctctatcagtacaatggggatagtattatgttaactcctaaagaagatagcgagacacttgattgtataatagcaatactttacatcccatgtgtactgtttcacattaatttttattctgaattacctgtttttacaacctatcacctgaaggtcccgatagtggcttaattctacatatctgaagtgtaagtccacatcatttgtctagcagcagtgtgtggaaagtaaagtagaattacacaggcagtggggtgtgtaatgggtgtgatctaactgcgtaaacatggaactccaactcccagactcaccctgtgccaatgctacatgatccgtggatgcggttcctattcattctgctgctgagatgaccgatagtgtcttaaaggtgtcaacagtgtgactttttttttagcacttcactaaaatgatactcatggcaaattgtttttaaaaaacaagcaatgattattctctaatatttaagttgtttctttgcagaaaaaactaaaatcactatagtaaaaaccttcaatgcatcaggtatgacttattatcaatatcaagactttcctttttataactaaagtaaaattaaacaaatggctggtgtttataatttctttctcttttttccaaacttttcaagataaaatctggtcttaacaaacagatgtgtatgcactgggtacctgaaattgtactaggtgtttggggctatataataatgatcagacacagagcctaccctcaagaatcttctagtctatgggtggagacaaggcaaaaaaatagataactaacatgaacatgcatgcagataaaggcaatgattatacaagtattactgacatggttaagaggcataggagtagagggggatgcaattaatgaagaagttagaggaatgaacctcaaatttttttttcctgagacaagatctcactcagtggcccaggctacagtgcagtgatgcaatcatagctcactgcagcctcaacctccttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcactaactcaaattataattttagtttgtacccaaactagttttctcatagaaaagaatttaaggatttgtaatgtgcaatggaaataaacttgcagttgggcattgcacacataattctgaccaaacaagacctaacaaggagacaaaaatatttcttaatataacaagtttttcccttggcagtttgtttaatacattatcagcatttgctcctcccatgtactatggatttcttatgctttgccaaaaggatgcaattaataaaggaaggctttttagagaagtaaaccttgagttcttttcaaattgaagaagagatacacttctcctctcaccaaaggagaaagtgtttctcaggttaatacgtataaagttttggttctgatgctcattttatctcccagtcatctctgtctcctttgtatgcctgtgtggtctgttgtcctggtcatcactccattttgccctcactaataagtaaattaaaaaatgctttttatttactggctagtatcatccactagattgtatgctccttgagggcaggatctatatctggaaactcccaaagcctgtagaatatggttaatgctcagcaaatatgttttgaattttgtagtttttgcccatgaaacaatattatgacattaatgttatttcatacatacatttgcataaagagctaggattaacattagagtgttcatagactcccctacataggaaaagaaggaggatctatgattaagggccattccatttaaagtctctacttggtttgtgttcatggtgctctgtttatactgaacaggagagggattaattgggaaggggtcaaaaattttagggaggagttaaggatcagatattgacatactaaagattagtaaagaattaagttccgtagctgacaaatgaccaacaaatgaaaactcatttctttagtctttgtggaattcatccatccaattaattccagcttataatatttctggtccacatttgatgcctacgtttatgaattctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctccttaaaaaaaaaaaaaaaaaaatcaccatgctagctaaggagttttagaattttgggagtaaagaaggctttcaattttagggaaaatgcagttttctgcagtatgaagtttccacttggaccactgccttaaaccagtggtttgaaatcttagctgcacattagaatcacctggggagcattaaaaacactgactcccaagactcaccaactaaatgttttgtcattttaaaaacatgtttgacggtctgataggtgagaaatggtagctcagtgttactttaatcaacatttccttactaaggcagagtctgaacattttttcatatatttgggggctgttttgtatctttttgtgaattacatgtacatgtcttttctgtattttttctaattgatatctgatccattatttaagagtactttagccgggcacggtggcttacgcctgtaatcccagcactttgggaggccaaggtgggcggatcacgaggtcaggagatcgagaccatcccggctaacacggtgaaaccccagctctactaaaaatacaaaaaaaaattagccgggcatggtggcgggcgcctgtagtcccagctactcaggaggctgaggcaggagaatggcatgaacctgggaggcggagcttgcagtgagccgaggttgcgccactgctctccagcctgggtgaaagtgcaagactccgtctcaaaaaaaaaagtacttcatatattgtgcatattagctctttatatgcatatctatggtatatgttgcaaatattttctcccagtattttagttgtcttttgactttatcatgttttttgtcatggaaattttgaaacaattttatgtagttaaatacgaaaaagttcatcttttccccagtgatctgagatgtcacctttgtcttatactaaattttgatagacatttgggtctaattctggatgttagatgttaacactgggtgaccaagctgcgtgggaggtatacagagctgtttgtattgtttttatagtatttctgtaaacctaaaattagttccaataaaaagttaaaaaaaaatactgattcccagtcaccaggctcagagattctgatttaattggcctgggatatagcctaggcattaaggcccttctggaccaggcaaggtagctcacgcctgtaatctcagcactttggaaggcccaggtaggagaactgcttgagctcaagagttcaagatcagcctgggtgagatctcatttctactaaaaaattaaaaaaaaacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggaggacaggaatgaaaatgttcactgtggttccccatgagtgacctgcctgctggcattatgagttttgtttgttttttttttttactttttcttttctttcttactttgcagcattttctatattcttctacaatcagataaaaattgtatttggaaaaaaaggacttaaaaaaatctgtgtagcttctcagatgggaagagaaggctaagtgtagcctgtctgccctttgtgggccagatttctgggatatactaatattaaaacgttggaccttgaggaacaggtaaaagtctttggttaaggatttgtagcaggattttctgcaatagaaagtaaagagtaacatgccccattcagcttcacatgccccattaagctggagcattgagccccattttggggatagagtttctggaagcattgggatcggatcagaagagcatccctcttttgacgcagccccactgacccctagtggctgcccctagtggttaagaagaagaaacaggaatagaaaaggggtcaggatgtgaaactgatgtccagttagggctcagtcattaactagctgtgtatccgtgttccagagcagatgcttttttaccttcagcatctcagatcaaatgaagaagtgagttagagctctgtaaaattaggaaatggactggatcaacacttctcaaatatcaccgtgcacatccatcactcaggatcttgttaaaatgcagattctgatccagtaaggcctgggcctgaaagtctgcatttctgacaagctcctcaggtgaagccagtgttgctggttcatggaccccactttgagcaccgagggtctgtatagagactgtagagcagtgctagtggttctcaatcctggctgcatgttgaaatcctctggagcgttttaaaaacattgatgcagctgggcatggtggctcacgcctgtaatctcagcactttgggaggccgaggtgggaggattgcttgaggccaggagttcgcgaccagccagggcaacatagtgagaccctgtctctacaaacagtttttaaaaattagccgggcagggtgatgtacacctgtagtcccagctgcttgggagactgaggtaggaggggtcacttgagcctggggagtggaggctgcagtgagtcatgatcatgtcactgcattccagcctgggtgataaagcaagaccctgtctctgaatgaatgaatgaatgaatttaaaaatacatcgatgggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaataaataataaaaaataaaaaataaaaacaaaaatacatcgatgcctgcctcccaccctcagagactggtgtaggatgtggcctgggcttcccagtttttaaaaactcctgggtggggtggttctaatgtgcagccaagttcgagaaccactgggctagaattagatgcccacccagggtctttctaatatgttggttcttaggtttaactgtacattagaaatacctggggtatttttaaaacatactgatgtgtcaaggtggccttctagggtgctggaaatgctctgctttgatctaggtggtgattatatataaaattcgtcaagctctaaatctaagattagtacactttatgcaggctacaccgcagtaaagaagcacattaaaatgccatgcattaaaatgggcactgcgcccaccgccagaggttccaggtcagctggtttggagtgggagcccaggcatcggtgccgaggtactctgaggggttcagatgtactgctggcattgcccaccactgctctgccgcttccctgtgtgcctcacagtggatggagggctctgactagcataaatgacaggagtagaaggcaacctcttcacagttgagcccagtgaacggggccttctgaaggcccccagataagctgaagaaaatttaatgtatactttgcaaagcacctttaccccaacttggccaggtgggttgctacagtgtacagtttagggaatggagcctgagagatgttgggtaaattgtccacaggagtagtgaaagctggagccctagtgaaggttgtttgttcgtttgtttgtttgtttctgagacagagtttcgctctttcacccagactggagtgcagtggtacaatcttggctcactgcaacctccgctacccgggttcaagtgattcccctgcctcagcctcccgagtagctgggattataggcacccgccaccacgcctggctaatttttgtatttttagtagagacagggtttcgccatgttggccaggctggtcgcaaactcctgaccacaggtgatccactgcttcggtctcccaaagtgttgggattacaggcgtgagccatcgtgcccagccaagtctaggctttttgactcatgatgtttctgactgtctgacaccctttatcctcactgccccgaacctcaggggatgcagggaggcctgtggccaagtgaccagccagactggaccaagcaggcttttctttttatagatgtgacttgctttaggccccttgacctaatattcctccctcttctcaccctagagaagctctaagaacacattcttgttggtgttctaagtctccatctgacactagatcgatcagaggcttccttgagtaaatattccctgggtaataatttgttgctcctcctctagttgttcctccctagatctctcaagactgatggatcttgtgccagagagtaggtgaggacttctccacctttgatgcccatgaaaatcaccagagagtttagaaaatacatatgccccatcccaagaccagctgaatcaaacacagaggagtgggccatagaaatctatatacacatatgttttaaaaagtgttctgggccaggcacagtggctcacgcctgtagtcccagcactttgggaggctgaggcgggcagatcatcggaggtcaggagttcgagaccagcctggccaacatagcaaaaccccatctctactaaaaatacaaaaagtagccgggcatggtggcaggtgcctgtagtcccagctactcaggaggctgaggcaagagaatcacttgaacccaggaggcggaggttgcagtgacccaaaatcacgccactgcaccccagcctgggtgacgagtgagactctgtctcaaaaaaaaatgttctgggtagttctcatgcacagccaaggttgagaaccactgagctaaaggaaccttgaagacacagctgctgtagaccacctcttttgccccagcttgattcattgttttcattcaaccaacatttcttggtcagttaccatgggtcagctaccactatgccaggctatagcagtgtaaagttgattaagacagattcctagtatatgaaaaccagttgggtcacgagacatttcgcagttcccctcacccgggagcacagagaagattccctcaattgagtgaccatgagacacagagccacagagcagcagtgaactggggagtcacagaagagcatctctccttgcccattcctctcccaggaagtaggtggtagaagtgggcaggggctgggggatagtggcaggtgcacagagggtgtgaaatggcagaggctggaagtgtcatgtccctgatgtaactacgtcaacttgacggtgtcagatgattgccagaggggaaagacttgccccctctgtagctcattcgtgtctcacatgtatctctctgatttgttcctttagtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacaggtaaatgtcacttgaacagcggccaatctgccaatcaagacatctatgataagaccatgttgagcctttctttgtatgatgttcgcttgatttctagagctttcctttcgggattctaacgttctaatgacttacatggttgcataagagtcattgtgttgaggtggcatatctaatttaatcaatatctaatttaatcattcctctcttctgaaaccattaagtttattctactttttagctcccaggtatcggtatctttcatgcagttgtcactttgcttcttggctgtggctgagttccattgttttgaccaagataatggagaaatagctctaaagggcaagcacagatctcatttgatggagttggagattttctaggtttctttctcctacaaaagttggttggaacactgttttcaacaccctgaagagtaaacttttgatctattaaacatagcagctcagcttagacagaagacaaaagaaaaaattggcaggtctgaaaatcagtcagtcacagagtgacagagctgggactgagccaaggtagtggtaggaggggagaaacactgtgaagacccaggcttgggtccgcacgggccctcgcagacagtgtaatctggaacaagctccttctgcctccgcctgttctatgcgaggatcaaaatcatcacactaactgcatgaggctgagaatgaaggtgtacgtgagaatgctgtggaaaccgccaaggcctccagggtccaaagtgggcttagtggtacagagataaaggcaagagggaaagaagctgagagaaatctggatacactgaagtttcagttccatgagtaagaggcaggtcttcctctagaatttggaggatgggggaggcaaagccaagtttttggtgacattagattgattttggtacccacctcctccaccctggtgccagcatcaccaggagatgaggagcttctgccaaatgacttcatatttcttcaaatttgcactgctctctcttcagtaaagttttttaaattgtttctttttttttttttttttttggtagctttggggtcttgctatgttgcctaggctggttttaaactcctgggctcaagtgatcctcccacctcaacctcccaaagcgttgggattataggtgtgaaccattgtgcccagccaataattttttataaatgtaaatattttcagccaaattagaaaagcattggggctgtagtcaaaggaaggtccaatggctgatgaagaatacagtaaaattgaagttcattagcctgggcctaagatgcccaccttcccaaagctaattcccagtgatccctagactcagcctaacaggctacacaaaacactatcaaggtggcctctggtgcctatgtattcctggggcaacaagaagcaaagtgacatattcataaaagatacagattgaggtgttacccaggagctaaaaattagaataaacgtaatggttccagaagacaggaatgattaaataagatatgctactgtaacacaatgactattatgcgaccatgtaagtcattagaacagaaacagaaatatacagaaacttgggggcattttcaagtcttgatgtgaggtgaaaatagcccaacaacaaatagtttgcacaccatgtttataacagtgtaaatacacatgcataaagatttgacgggaataggcaaaataataggatgttaagtggtgaaattaagagttgtctgttgttaaagacaggtttgtatcattgtttccctattaaaaatcagacttacaggtgatagtccagctttcataatattcttttttgttttgagagagagagagagtctcactctgtcacccaggctggagtgcagtggcgcaatttcggctcaccgcaacctctgcctcctgggttcaagcgattcttgtgcctcagcctcccgagtaactgggactacaggcacatgccaccacacgtggctaattttttaaatatttttagtagagacagggttcccccatgttggccaggctggtctagaactcctgacctcaggtgatccacctgcctcagagcctcccaaagtgctgggattacaggcgcgagccaccgtgcccagcccataatattctctttttcacaaaagagcttccagcaatccacataaaatcctgtacacatgatacaaattaaatacaagtatacttgtgcttatatgagtatatactaaatacactgatgtgctttatattttttagatttattgaagtaaaatttgcatacagtaaaatgtatccaattttatggataaatcaaatttttgcagttctgtgcagctagaaacacccacagtcacgtaaccaccatcataatcaagatacataagtttcccactactcccaaagttcccttgtgtcccttcgaagtcaaaacctaatcccctcacccccagcccctggccaccactgatctgtttccatacaggtttttggatatttctagaatatcatatgaagagactcacttagtatgtggccttctgagtttggcttctttcacttagcataatgtattggaaaactggagatccacccatgccattgtgtgtatttagagttaattcctttttattgctgaataatatttcactgtatggaggtaccatagtttgttgatccattctccagttcatggacattcgggttgtttctagtttgggactattatgaaaaaggccactataaacattcatgaacaagtcttcctaagacatatgtttgtatttatctggggcaaatacccaggagtgagtttgccatatcacagggtctatgtacgtttatctttattagtgggttttccattgtgtgttcataacacgatttggctctttgatatagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaaggtacgacttcgcaaactgaagtggtggtaagaggggaccctccaaagataaagatgctgctcacatgattaatatcaccaagtcttttactcccaagtaccaggtacatcatggtttctcaggttgctactctatattctgcttagaatgaggagacagatgggactgccaaatctacactaccaaccttgaggccagacattgtggctcatgcctataatcccaccactctgggaggctgaggtgggcggatcgcttgaggtcaggggtttgagactagcctggctaacatggtgaaaccccgtctctactaaaaatacaaagattagccaggcatggtgatgcgtgcctgtagtcccagctactcaggaggctgaggcaggagaatcacttgaacccaggaggtggaggttgcagtgagccaagatggcaccactgtactccagcctgggaggcagagtgagactctgtctcaaaaaaaaaaaaaaacaaaaacaaaaacaaggctgggcgcgatggctcacgcctgtaatcccaacattttgggaggccgaggcgtgtggatcacgaggtcaggagatcgagaccatcctggccaacatggtgaaaccccgtctctactaaaatacaaaaaattagctgggtgtggtggtgtgcatctgtagtcccagctacttgagaggctgaggtagtagaattgcttgaacccaggaggcagaggttgcagtgagccgagatcacgccactgcaccccagcctggcaacagagcgagactccgtctcaaaataaataaataaataaataataaactgccaacctttctttacagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtacatcataattgatggcagaaaaaaacattctcttgtgtgtgattgtagtccccattgtatttcatgattgaggcaattactgcttatagtcaggggtgatattcaaaatatttggcatctagaacagtgaggcaccatagaatcaagccgggtgccatggctcacacctgtaatcccagcactttgggaggccaaggcaagtggatcactggaggtcaggagttcaagaccagcctggacaacatggtgaaaccccatctctactaaaaatacaaaaattagccgggcgtggtggcatccacttgtaatcccaactactcaggaggctgaggcaggagaattgcttgaactcgggaggcagaggttgcagtgagccaagattgcaccactgcactccagcctgagcgacagagtaatattccgtctcaaaaaaaaaaaaaaagacgttggtcttggctggtacaggatgtcagaggtcccccttacaccttgcgttaaccctttagcagctgaattttggaatgtggcatgggtggtatccagcagagggttctaggcaattgggagagtaggcaggggtgtcagctacttaacatcacatttcgatattataacaagtgttagaactgcactgctgtatatagtggtgctgagtatcattcctgtttctagtgttttctgtccacctatttagagggattgggggctacaaacacccaaggaaaccaagtctcgctttttaattttcatagtcttccctttacaagtgtactgcacatggttctatgaggacttgactctaactggtcactaacttggtgtgtctgctgctacagtctccctggggtctgcagtcatcttgcacttttcaactatttctttgcatccttaaaatgtttcctttccttcttggaggcctcctctccttattacacttccttttttttctttttttttgagatggagtctcgctctgtcacccagggttgagtgcattggtgcgatcttggctcactgcagcctccgcctcccgggttcaagatactcccctgcctcagtctcccaggtagctaggattacaggcgcctgccaccacacccggctaatttttgtatttttagtagagacagggctgcgccatgttggccaggctggtcttaaactcctgacctcaggtgatcctcccgactcggcctcccaaagtgttgggattacaggtgtgagccgccgtgcccagcctatacttcctttctttaatttagtagcaaccagaggaatagaagtagaagctattttgcatagagatgccgcaggtcaggtccttacagaaccctgcgttttaattattaggctggtgcaaaagtaattgtggtttttatctttttttaaaaaaaaaatggcacatactgcaattacttttgcaccaacttaatagatgtgttttccatctcattatactagctccagacatttattcttatcttccacttgattttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgccaagcactatcctaagcagttacaaatgttaactctaatcctctcaacaaccctgagaggaaggaactattattatcccattttacagatgaagccatggaggcgcagagagacgttaagtgacttgcttggggacacacggcttaaatggcttaatgctatgttctctttaaagattcacaaaatcctgttgtgtcaatctgtgcgctttagctcagtatttagagcattgtattgtagaacaagctctgtttctctgattgtgatcccttgggaaagtcactttcctccttgtccctcgatttctgacctatattgtaagataaacaatgtggactgaatattccttagtgttccttctagctctaaaactctgacaatatctcatttacccttgccatcttgatgtgccaggatccttccctggagaacctctctctgatcagctacgtcatatcatcgagtgttgcaaacctgaccgtcaggaacttgacaagaaacgtgacagtcacattaaagcacatcaacccgagccaggtggggagaggccagtgccgtctgttcattgaccaggaacaccttgtacaaactatgcttgtaaggcatggccggcaaaaggcagatcaggcagaaagaaccttcagctcagctggagtagtttgcaggactagaatcacatctctccattggattttaacacacttaataattgaccagggcaggtgcagtggttcatgctgtcatcccagcactttgagaggctgaggcgggcagattgtctgagctcaggagtttgagaccagcctgggcaacatggcaaaaccccatctttgcaaaagatacaaaaattagctgggcgtggtggcaggctcctgtaattccagctacttggagggctgaggcgggaggatcacgagcccgggagctcaaggctgcagtgagctatgttggggccactgcattccagcttgggtgacaaagtgagaccctgtctcaaaaaaaaaaaaaaaaaaaaaaattgaccacctaatttccaggaagaattggtgcaaaagcaagctcttaacaactgtgaaatatcagatatcagtgtgtgtggatctgtggctgcaggtctgattctcagctcagttcacactaagcatcatctacgacctcactactcacagtgtggtccacagacccacagcatcagcatcacctgggagtttgctagaaatgcagagtctcaggccctaacccagacccactgagtcagaatgtgcattttcacaaggccccaaagtgattcctatgcacgattgatgagcttaagaagtgctggtctatttagggcttacttgcttctagggaccatataaaataagaactctctaaaaattaagcctaagattctgaaatttaaaaaaaaccacagttttttttcttttcaaatacctttcagttttgctttttttttttttagttcagtaaattaattatgtgtgatttatctttctaccacaggatgagttaacagtgagatgtgtattttgggacttgggcagaaatggtaagttccagtcataaccttttcaaactcttgagtgggttaattggggagggtgtgaagtcactggtgctgtggccttgctgatgggacagatgttcttcccaatgccaacaggtggcagaggaggctggtcagacaatggctgctctgtcaaagacaggagattgaatgaaaccatctgtacctgtagccatctaacaagcttcggcgttctgctggtaatatgcctgtgccacgtggccttaaattctgagtctgaggggtagctgggcatcacactacaatgtctaatctgatggatggataaccgtgacagatcagcagatatgatattgtggctgatttatacaccaatgagattgctctttgctgggcatggtggctcacgcctgtaatcccagcactttgggaggccaaggtgggtggatcacttgaggtcaggagttcgagaccagcctggccaacatggcgaaaccccgtctctactaaaaatacaaaattagctgggtgtggtggtgcgtacctgtagtcccagctactcaggaggctgaggcaggataatcgcttgatcctgggaggcagaggttgcagtaagccgaaatcacaccattgtactccagtctgggcaacagagagagacgccatctcaaaaaaaaaaaaaaaaagagagagagattcctcttctaataagcaaatgcacctgaaggaaaatacctgaacatgaaagacaagtattttttcacattctctttttacatttaagtttttctcttttaaataattaagagaactaaggaattcagattaggatgagtaataaaaattgtttagtttgcaatgcactttaagatttttacaaaacactttgacataaatgctcttatttaatcatcccaacagtcctgcaagataggtagaatggggagttgctattgtcattttattaaaatcagaattaagactctcttgttagatagttgcccacagtcatagaactaagaaatgtaagaggcaggagctaaattgcagtctttaggctcctagtccagttcctttccattgcactataatgcagtgatcaagtatgtgggctttggagtgtgccagacctgaatttgaatcttggcttctccactttctatctgtgtgtccttgagcaagttacttaacctctctgtgtctgtctctgtttccttatctttacctgatagtaataattgtgcctacctcataggtttgttgaatagactatgaatggatccctagaatacttgatacatcataagtcttgtatttatttaaaaatatttgattattaaaagcaatatttcattttccaggacctatctaggacatctgtgctgcctgctcaaatgatggctctgacgttcattacatatattggttgtgggctttcatcaatttttctgtcagtgactcttgtaacctacatagcttttgagtgagtatccacaaccggaaatttggatttaggactcagcactcacctccattgccaacatttattaactaagccctttcctcggcctgccttaccctgtacacccagctagtggagcatccatgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaatagatattcagtgagtgtagctctgcagcaagaatgccattctaaaaaacagcctttccttcttggcttaccagacaggtccctttggttgctttttgggggtaattccaacaaattctaatggaaaagaaggacatgggcatttttattgcattaacgaatcgaaacaatatgtaggttcttggatttagattttggacactgatcaggaaatgtaaaaatttattttcagtgccaaagttagggtctagctgtgactacggatcttctagtgagcctttggaaatattattagtgagactaaataaccagaaggccagccattactcagaatgatttcatcggatctaattttgcatgcataaacatgaacatgtcatcaattagctggcttctcctatgctattacatttagctgtagtttaaactcttctttccatgatctcattttacctaataacatacaataatatgggaatcttggttaaattttgaagatctgaatatagcagactccatgagaagcagcaccaatgcttccgaaagtagtctgggagaaatagggcgagtgcttagtagagtctactacaaactatttaaaagtatgcgtcaacagtcagcatgtaaaaggtcccacagaaatacagacacaaattctccttatggttatcacagatgattctgtttagatttttcctttgttgttgttggttttaagctcccccccaccccatatacacatatactcaaacagaggaaatttatgcatatagacatttaccaaagaataaaaataaattgcttaaaactcaaagagcctgacagatatgcttacataagggttggtgctaggtgtggtaactcatgcctgtaatcccaacactttgggaagccagggcagcaggattgcttgagcccaggagtttgaggccagcctaggcaacatggcgaaaccgtgtctctacaaaaaaaataagggtgtggtagagagcgcctgtagtcccagccactcaggagactgaggtgggaagatcgcttgagcccaggaggcagaggttgcagtgacctgagatcacgctactgcactccagcctgggtgacagagccagaccttatcttaaaccaaaaaaaagttggagggttggcagagtagaatgctcattcttgttctcatcctttccttttagaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggtatgtataagcttgcctgcatgttgcctggactttctctgccttttctctagtgttttgatttttgagcaggtggaaacgatgaagcagatcacattcagcaagtttctaaaacagctttatactcttacatgtgcactgcccgaagagcaactttgtcaagtctccttctaggacacctgtttatttctttggatttgttatgaatatggaattcctcaaggttgaaccatgaatcctctttgtatctccaggaactagaatttggggctggcacagaaggtgctcaatatattgaaaacattagcttggggtggtaatatattgaaaacattagcttggtggtaaagagcccaaactctcagtccctgagctcccagccagcctcattctactttgtacctcccagatatcagacacgtatgacagtatgctaagaagggcagagtgagagaatgtacatataaaacccattgtaacttcactgccacgtgggcatgacatttcagattgtgcagcctattggtggcaggtcgcaaggccttaggctccccaaatatgttgaagatttcttcattcaatttcccacccaatgcaggagcctcttcaaccctcaactccacctgacttatccttgactaaagataatctaacttctgcttgaatacttctattactggggagttcatgaccttacaaggcagccaataaccattttataaagctctacagttctgattttccattaagttcagttggctccctggtggcacttaccagtggttttgctcaggcagaaaacagtaagttgatacctcttctgccagagagtcctttagataatctacaagtaatatataacagtgtgtataatcccctgtttttcacacaagtgaccccatgcaagataagccagtgaggtgagccaggcagtcatcccaaatgtaggtgaagaaactggctccaagtgatgatgtgatatccccccaattcacaaagctagaaaacagcaagcctggctctccgtctccttatatgcagccttctgccatccccccaaccagactgcctctattttcaggctaaatattcctacacatcaagattgaaagcacaccaccacccttgccaccctgccttctatcttatgtcactatgtctttgtgaagaacaacagaacaacaccctttccctgtttgtcccagaaacataagtcaacgctccagatactgggcacggattctgtcttctttagagaaggctgaaagtcagattcctttcttaagtatgaggcccccacccccaatgttttatttttaacaaagtgtctcacttagaaaattatcatatgtcagggtcaccagaaggtacaagcgcaaaggcattaaatgaactattagatttgattttaccaggcactgcaactggtctgtgacaaggaattgtttgttctttaccagagccttgagataggacgtctgctggtcagtgtgcagagtgtggggcggtggcatggggctggcgggtgatggtgtgcagtggtgaataggattctttccccaccaaaagccattttaaacttgggggacccttctcatggtaccttctctgaagggaagtgtccgtgggctctcaacagagccagcatagtagcagtcaccaccccctggatcagccaggacagaaccctccatccttcactgggtctcaaagtcttcaaattgaggacttttggtttcataatgaaagatttgccaggagttgctgactcttaaatatacattccagacatgtataagttaaaggcacaacgctgggtgcagtggctcatgcctgtaatcccagcactttgggaggccgaggtgggcggatcacctgaggtcaggagttcgagaccagcctagccaacatggtgaaaccccgtctctactaaaaatacaaaaattagccaggtgtggtggtgcacacctgtaatcccagctacttgggaggctgaggcacaagaatcgcttgaacccgggaggcggaggcggaggttgcagtgagccgagattgtgccactgcactctagcctgggtgacagaggggggccgggtggggggtggggagttaaaggcaacactggcagctgtaacagattcaccttgaaatctcagtagaagatcatttctcactcacctacagtctagttagcaggggcagaggagtccctggtcttgcagttattcagggatccaagctattgaagactctgcctcaaggttgccctaagtttgcaggcaaaaagaaagtagaggatctcacaggaggtttctatggggcaggcctggaagtggagcaaatcacttgtgcccgtatcccatgggcccaaagtgagccatgtggccacacacacccagctgcctgggaggctgggagcatccagtcatgtgccaaagaggaaaagaaaccagcctggtgaacagctagccagtctctgctacaagatgtaaataggatgtgatctctagtcttgtcacccactttggttattagaactaggtgtgaccagccgggtgcggtggctcacgcctgcaatcccagcactttgggagaccgaggcgggcagatcacgaggtcaggagatcgagaccatcctggctaacatggtgaaaccccgtctctacgaaaaatacaaaacaaaaattagccaggcatggtggcacgcgcctgtaatcccagctactagggaggctgaggcaggagaatcacttgaacccaggaggcggaggttgcagtgagccgagatcgcaccactgcactccagcctgggtgacagagcaagaatccgtctcaaaaaaaaaaaaaaaaaaaattaggtgtgaccaatgtttcccatcttccaggggtaccagctgtggttgtgaccatcatcctgactatatccccagataactatgggcttggatcctatgggaaattccccaatggttcaccggatgacttgtgagtacaaagccccctaagggaatgctaagtgaactggaaaacggaatgctcctagaaaacggaggatctaatcagcatattgactcctgctatcatcctaataaaacccagcaatacttcacagcagccttcacagtcatatgtaatgagagaagctagctggaaatgccatgctactcttcaagtgatgaattaggagctattctgaaaagaaaaatgaattaggaagaactattttgaaaatattttcattagcctctgataaaatgacattccagttatattaataaagactcatagaacagagttgctaggatttacaggggcaaaatcctgaatgtttaaaaaaaggtctatttttaaaatactttaaatcaccaagtgtcctcaaataaactcttagattattttccctagagctataaatggttgtagagaatagcagttttatcattttttttctcttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagagatgttgggggtttggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaaaaaaaaaaaaaaaaaaaagtactatctgtgaaaccccatgaggtatgcttgtatatgcaaagtagcttatttagtggcttatgatattttcattgaaaaacatatttattattgagagggagtgctttgagatccttggaggaaaggtgcttactaaattcaagaaatggtgtttttttctccttattcatagttgtctccttggagagaccatattgaggggaacctgccaggaacactttttgaaaaagtcaattattcttccttcacttggtttcttttaaaaaaaaaaacttttgtattcaagtagaacatgcagactgtaagcacacataccatgactgtgcctgtgggagctcaccactctcccctcctaggtcagcgatttggagacaatgagaaatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgctgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctgtttctctcctaatgcaaccaatggtcgacttccagggtgacaaatgaatgaagctgtgtaatattcagacatgggtcttgacggtgggcacatataccctactagaagcaaaactgttttgtttgtttgttttttgagatggagtctcgctctgtcacccaggctggagtgcagtggagcgatctcggctcactgcaacctccgcctcccgggttcaagtgatcctcccacttcaccctcctaaagtgctgagattacaggcgtgagccaccaccacgcctggcccctggtatcttaaaatgaaggttttaaagtgaatagattgggggtttttaagtagaaagcagagaacccagaattcatccattcactcagcaaatatttattggcaaaagccttggggagtggcagccatggggctggctggggagccctggcctgccttgactgggcacctgagtgggtgagaggtggagtcccagggccccttcaggtcttcagcttgctctccatgccagcacctggggcaggtcaggaggaggcaggcaggtaggtgagtgcattgctgtactgcctgggtttgagggggagagagagatccaagcaaaggacatggcagtgggctggagaggaggagagtgggaagggaaagatgtgtggaggagatggcatttgacagagcttggaaacggattctaaatagggagggagggagaggcaggagcctaagtccaagctgggatcctgggtggatggcttgtaattccaagatacggaaggccaaggacaggatgtgggaggagacagtgaatttaattgtggaaatgcaaagttatgattccttttatcatataaatattcttaatcttacaaagattttctaaaggcattcattccccgatgccttttgacagcaagctttcctaggactctgaactttttattcaatttgcaaaatttcatgttgcccacagctgccaaaataattattaatatcttttgtgcaaagtgagcttatgacattcagctattagcttggaattcattgtgggttttttttccctccttaggatttttcatattcatcttttactgtgtggccaaagaaaatgtcaggaagcaatggaggcggtatctttgttgtggaaagttacggctggctgaaaattctggtaaagatttacctcactttttctcttcctcttaaatctcaaggaaaagattgtataaattaagatccaaagcaaatccaatctagaaatcagtgaattccagcaaatctggaatttgctcaacagaaaatattgatcgtgaacattagggagaaaaaaaaatctagtgaattaaaaaataattatttctatctgggaattttttgagcaataaaattgatgggctggctgcctcttcaatgaagcaacagtaaaatttttagaattgattttctattgagattatgcttttcatttcccaaagtaatttttaatatttaccttggtaatttttaaaatctcaactcaatcctttctccacaggtcctggttgtcagttgctttatttgttagtaagccagactttgtgtataagctttagcatacatttggttgtaacatacatttgtttattttgaagtgattttcacatatacccggttgggtagtagagcaaatagctcattttttttttttaagaaaatgagaaaaatgaagtactgtttgaaaagctacattccttttgcatgaataccacctttgcagtatctgggcgacacgggagtctgtattcagaaaatggcagtacacatagttcaatcattttcatggagtgaagaacaattagtcattacaacacagactatttgtgttcttgttaagacagtgtgaggctctgaatcactacctaattctatggatatttatagacataatcaaattagcttggcctttagttctaggagaatataggttacttttaaccccacagtcatttgaaggacaaatgtaaataatccaaatgaaaatacatgttatcacaccaactggtggaaggtgacttctccataagatcctgaagtgagaaatcagttgcttaggacttgttacactgtgatctgtctcttgcgtttgagcttcaacatactgccctgtttttctgtaatgcttattctgctgtagactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggtatgtatgtctcaatatagtatttctcaagctagtgtttattttttaaaatagttttatcctttattggcattttggctaagcaaagtgagtaactattaatacatatatgactagtggatcaaaatgtggttcccttacagaagagaaagtttactaatccaaattgatttattatagagcaaatactggaacaacgattttttaagatttggtttttcatagtgggaattgatgatgacctaaaaattttaacattttaaatcctcacttaactattgtccaaagacttcagtattgtgctatttctgtgagagcagtacctaaaatagctgataagactatagcaatttttattacatctatcataatatacatgttcaacattttttttttttgagatggagtctcactcttgttgcccaggctggagtgcaatggtgcaatctcagctcactgcaacctccacctcctgggttccagcaattctgcctcagcctcccgagtagctggaattacaggtgacctacaggtgaccgccacgatgcccagctaatttttgtatttttagtagagacaggtttcaccatgttggccaggctagtctcgagctcctgaccacaagtgatttgcccacctcggcctcccaaagtgctgggattacaggtgtgagccaccgcgcccagccaacacttttaaaccttcctattttttgcttttcatgtttgttaattctttcccacaatgtggctgtcttgtgacagcacccaaatccccatgaatatgtcaaaatactggaagatgacttgtgaccagtattggtgaccatatatgtgaccaatatctgaacagattattgctgccatgcctcctttactcattaattctgacatttctagctaaaacttctgttacattttctttctttcataagaccaggctgttcattactcataaaagcttaccttatctatttttaccttctcttgcttcttaatatatcttttgcattcttataaaaacataagctctgctggtatagtttctccttccatggagaatttgcctgtattcattgttttaggatgttagttcttttcatgactaactcaaataaatttgtgagaaggttcatacatctaccagttttcccgtttcctgaagatgggcagtcctgctggtgtgtctagacttttttttttttttttctttttttttatgacaaggtctcctattgcccaggctggagttcagtggtatgatcacggttcactgcagcctcgacctcccaggctcaagtgatcctcccacctcagccacccgagtagctgggactgtaggagcatgccaccatggctggctaatttttttttttttttaagatgcagtcttgctgtgttgtccaggttggtctcaaactcctgggctcaagtgatcctcccgcctcagcctcccaaagtgctgggattacaggtgtgagccactgtgcccggcctgtctaggcttttaaaataccataggatgcctcaaaatcaaggtttctcaacttcaagcacaattgacattttggggctggataattcttttttgtggaattgcaggacatttagcaggatccctggactctatcaactagagccagtagcaccctgcccccagttatgacaacccaaaatgtccccagacactgccaactgtcccaggggagcggggagaagaagggagcaagattgcccccagttgagaatcactgctgtaaaagatgagaaataactgttgtatagccttagctctttactgtcgataccagaaagcaagctctgggctctacaccaaatagctctatcaggaatgattcaatgtaggtaaacagaggcgaggcagcggggagcacagctggttagtacgttagtgtgagaaagcaaattgaaaggagagacatcaaaggagcgagcagggtcatctggggctctgaatccataaaccagatttgtccatattctcgaaagagctcagagatgaagcctcacctgcctagctctatcaacatgttgtcatcctttgggaaatcagatttcatggaaacagcacattttaccacagttgtttaacacagctgatttgacacagctacttttgatgcttgacggtgaggatgggggtacattttaaggctgccaaaatggctcagtgtttaatatcacataatatgcatgtcagataaccattcctgactcctcagtccttgccccagcatctgggatagatgaggaatggaattggcaatttcaaaaaagaaagctagggctgggcgcagtggctcacacctgtaatcccagcactttgggaggctaagttaggaggatcacctgaggtcaggagttcaagaccagcctggccaacatggaaaaactccatctctaataaaaaatgtgaaaatcaaccagacgtggtggcacacacctgtagtcccagctactcaggaagctgaggcaggagaatcgcttgaacccaggagacagaagttgcagtgagcctagatctcaccactgcactccagcatgggcgacagaacgagactccgtctcaacaacaacaaaaaaagctagaagtttaatgatttattatgccagaccaaattgttcttgcaccaaaatgtcctcaagccgaaatgcctaaatccaaacagctgcctcagacagtcacatgccctatttgatctgtgtcacagatggagctacgttaaccatattcatcacctagtttgcatgaatattacacagttcagttctgagctgccttagagggtggggtaccagcagccatctcatttggtacccaggaccacaaggatcacagtttggaagcaacatcacacgtcaactccattacttctgagctgtgtgaccttggggagagcacttaatttctgaaaccttcgtttcctcatctgcaaaatggggataacagtagtacccaccctgcagggctctaaatgagataataaagtgtcccagtactgttatgatcattgttatcataatcatgtcatgaactatcaaatgggcttattattcagctttgtgtatagtctcccaatggtctaatgatcagaaggatggtgccaagtaactagaggaggccagcacctgtgctcccctataactcagggcctgcttggggtggggaaggcccacgtccaaaccaacagttacccttgagtgcccagctgctccctggcctggactctgaagttggaattggtagtttcctcttgggaatttgtcctgtcctgatttagtcagaggagctggtttaatctacaagagagatgatttcttcttgccatgactgttgtagctggttgctctggtttctctggtacaaagtttcattttataggaacctagggaaccaagaacttcctaagggtacatatggggatctctgttaacattaaccttttgggagaccaaagtattaccttagcttatattatacatatgctgctacttgaagtcaaaacatatccaaccagagttaggaagtgggccttttattaatatattaccttgcttcagattttgactgtttcattaaaaaccaaacaaaaaaaaaactgccatagagaactggtttctgaagcaatctccactttggtatgcttactttgagtggccttagggaagtaatgaaaaataaataaaatatgaacatatatcacaaatgtttttaaaaacatattttacaaatacatctttaagaataaagcaatgtctaagtttgtttgctttttaatgctttctgtggatacttcatgccacccgctttgtgtttccttatacaggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagta

SEQ ID NO: 3171 - DNA, 40399 bp, human
attctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctccttaaaaaaaaaaaaaaaaaaatcaccatgctagctaaggagttttagaattttgggagtaaagaaggctttcaattttagggaaaatgcagttttctgcagtatgaagtttccacttggaccactgccttaaaccagtggtttgaaatcttagctgcacattagaatcacctggggagcattaaaaacactgactcccaagactcaccaactaaatgttttgtcattttaaaaacatgtttgacggtctgataggtgagaaatggtagctcagtgttactttaatcaacatttccttactaaggcagagtctgaacattttttcatatatttgggggctgttttgtatctttttgtgaattacatgtacatgtcttttctgtattttttctaattgatatctgatccattatttaagagtactttagccgggcacggtggcttacgcctgtaatcccagcactttgggaggccaaggtgggcggatcacgaggtcaggagatcgagaccatcccggctaacacggtgaaaccccagctctactaaaaatacaaaaaaaaattagccgggcatggtggcgggcgcctgtagtcccagctactcaggaggctgaggcaggagaatggcatgaacctgggaggcggagcttgcagtgagccgaggttgcgccactgctctccagcctgggtgaaagtgcaagactccgtctcaaaaaaaaaagtacttcatatattgtgcatattagctctttatatgcatatctatggtatatgttgcaaatattttctcccagtattttagttgtcttttgactttatcatgttttttgtcatggaaattttgaaacaattttatgtagttaaatacgaaaaagttcatcttttccccagtgatctgagatgtcacctttgtcttatactaaattttgatagacatttgggtctaattctggatgttagatgttaacactgggtgaccaagctgcgtgggaggtatacagagctgtttgtattgtttttatagtatttctgtaaacctaaaattagttccaataaaaagttaaaaaaaaatactgattcccagtcaccaggctcagagattctgatttaattggcctgggatatagcctaggcattaaggcccttctggaccaggcaaggtagctcacgcctgtaatctcagcactttggaaggcccaggtaggagaactgcttgagctcaagagttcaagatcagcctgggtgagatctcatttctactaaaaaattaaaaaaaaacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggaggacaggaatgaaaatgttcactgtggttccccatgagtgacctgcctgctggcattatgagttttgtttgttttttttttttactttttcttttctttcttactttgcagcattttctatattcttctacaatcagataaaaattgtatttggaaaaaaaggacttaaaaaaatctgtgtagcttctcagatgggaagagaaggctaagtgtagcctgtctgccctttgtgggccagatttctgggatatactaatattaaaacgttggaccttgaggaacaggtaaaagtctttggttaaggatttgtagcaggattttctgcaatagaaagtaaagagtaacatgccccattcagcttcacatgccccattaagctggagcattgagccccattttggggatagagtttctggaagcattgggatcggatcagaagagcatccctcttttgacgcagccccactgacccctagtggctgcccctagtggttaagaagaagaaacaggaatagaaaaggggtcaggatgtgaaactgatgtccagttagggctcagtcattaactagctgtgtatccgtgttccagagcagatgcttttttaccttcagcatctcagatcaaatgaagaagtgagttagagctctgtaaaattaggaaatggactggatcaacacttctcaaatatcaccgtgcacatccatcactcaggatcttgttaaaatgcagattctgatccagtaaggcctgggcctgaaagtctgcatttctgacaagctcctcaggtgaagccagtgttgctggttcatggaccccactttgagcaccgagggtctgtatagagactgtagagcagtgctagtggttctcaatcctggctgcatgttgaaatcctctggagcgttttaaaaacattgatgcagctgggcatggtggctcacgcctgtaatctcagcactttgggaggccgaggtgggaggattgcttgaggccaggagttcgcgaccagccagggcaacatagtgagaccctgtctctacaaacagtttttaaaaattagccgggcagggtgatgtacacctgtagtcccagctgcttgggagactgaggtaggaggggtcacttgagcctggggagtggaggctgcagtgagtcatgatcatgtcactgcattccagcctgggtgataaagcaagaccctgtctctgaatgaatgaatgaatgaatttaaaaatacatcgatgggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaataaataataaaaaataaaaaataaaaacaaaaatacatcgatgcctgcctcccaccctcagagactggtgtaggatgtggcctgggcttcccagtttttaaaaactcctgggtggggtggttctaatgtgcagccaagttcgagaaccactgggctagaattagatgcccacccagggtctttctaatatgttggttcttaggtttaactgtacattagaaatacctggggtatttttaaaacatactgatgtgtcaaggtggccttctagggtgctggaaatgctctgctttgatctaggtggtgattatatataaaattcgtcaagctctaaatctaagattagtacactttatgcaggctacaccgcagtaaagaagcacattaaaatgccatgcattaaaatgggcactgcgcccaccgccagaggttccaggtcagctggtttggagtgggagcccaggcatcggtgccgaggtactctgaggggttcagatgtactgctggcattgcccaccactgctctgccgcttccctgtgtgcctcacagtggatggagggctctgactagcataaatgacaggagtagaaggcaacctcttcacagttgagcccagtgaacggggccttctgaaggcccccagataagctgaagaaaatttaatgtatactttgcaaagcacctttaccccaacttggccaggtgggttgctacagtgtacagtttagggaatggagcctgagagatgttgggtaaattgtccacaggagtagtgaaagctggagccctagtgaaggttgtttgttcgtttgtttgtttgtttctgagacagagtttcgctctttcacccagactggagtgcagtggtacaatcttggctcactgcaacctccgctacccgggttcaagtgattcccctgcctcagcctcccgagtagctgggattataggcacccgccaccacgcctggctaatttttgtatttttagtagagacagggtttcgccatgttggccaggctggtcgcaaactcctgaccacaggtgatccactgcttcggtctcccaaagtgttgggattacaggcgtgagccatcgtgcccagccaagtctaggctttttgactcatgatgtttctgactgtctgacaccctttatcctcactgccccgaacctcaggggatgcagggaggcctgtggccaagtgaccagccagactggaccaagcaggcttttctttttatagatgtgacttgctttaggccccttgacctaatattcctccctcttctcaccctagagaagctctaagaacacattcttgttggtgttctaagtctccatctgacactagatcgatcagaggcttccttgagtaaatattccctgggtaataatttgttgctcctcctctagttgttcctccctagatctctcaagactgatggatcttgtgccagagagtaggtgaggacttctccacctttgatgcccatgaaaatcaccagagagtttagaaaatacatatgccccatcccaagaccagctgaatcaaacacagaggagtgggccatagaaatctatatacacatatgttttaaaaagtgttctgggccaggcacagtggctcacgcctgtagtcccagcactttgggaggctgaggcgggcagatcatcggaggtcaggagttcgagaccagcctggccaacatagcaaaaccccatctctactaaaaatacaaaaagtagccgggcatggtggcaggtgcctgtagtcccagctactcaggaggctgaggcaagagaatcacttgaacccaggaggcggaggttgcagtgacccaaaatcacgccactgcaccccagcctgggtgacgagtgagactctgtctcaaaaaaaaatgttctgggtagttctcatgcacagccaaggttgagaaccactgagctaaaggaaccttgaagacacagctgctgtagaccacctcttttgccccagcttgattcattgttttcattcaaccaacatttcttggtcagttaccatgggtcagctaccactatgccaggctatagcagtgtaaagttgattaagacagattcctagtatatgaaaaccagttgggtcacgagacatttcgcagttcccctcacccgggagcacagagaagattccctcaattgagtgaccatgagacacagagccacagagcagcagtgaactggggagtcacagaagagcatctctccttgcccattcctctcccaggaagtaggtggtagaagtgggcaggggctgggggatagtggcaggtgcacagagggtgtgaaatggcagaggctggaagtgtcatgtccctgatgtaactacgtcaacttgacggtgtcagatgattgccagaggggaaagacttgccccctctgtagctcattcgtgtctcacatgtatctctctgatttgttcctttagtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacaggtaaatgtcacttgaacagcggccaatctgccaatcaagacatctatgataagaccatgttgagcctttctttgtatgatgttcgcttgatttctagagctttcctttcgggattctaacgttctaatgacttacatggttgcataagagtcattgtgttgaggtggcatatctaatttaatcaatatctaatttaatcattcctctcttctgaaaccattaagtttattctactttttagctcccaggtatcggtatctttcatgcagttgtcactttgcttcttggctgtggctgagttccattgttttgaccaagataatggagaaatagctctaaagggcaagcacagatctcatttgatggagttggagattttctaggtttctttctcctacaaaagttggttggaacactgttttcaacaccctgaagagtaaacttttgatctattaaacatagcagctcagcttagacagaagacaaaagaaaaaattggcaggtctgaaaatcagtcagtcacagagtgacagagctgggactgagccaaggtagtggtaggaggggagaaacactgtgaagacccaggcttgggtccgcacgggccctcgcagacagtgtaatctggaacaagctccttctgcctccgcctgttctatgcgaggatcaaaatcatcacactaactgcatgaggctgagaatgaaggtgtacgtgagaatgctgtggaaaccgccaaggcctccagggtccaaagtgggcttagtggtacagagataaaggcaagagggaaagaagctgagagaaatctggatacactgaagtttcagttccatgagtaagaggcaggtcttcctctagaatttggaggatgggggaggcaaagccaagtttttggtgacattagattgattttggtacccacctcctccaccctggtgccagcatcaccaggagatgaggagcttctgccaaatgacttcatatttcttcaaatttgcactgctctctcttcagtaaagttttttaaattgtttctttttttttttttttttttggtagctttggggtcttgctatgttgcctaggctggttttaaactcctgggctcaagtgatcctcccacctcaacctcccaaagcgttgggattataggtgtgaaccattgtgcccagccaataattttttataaatgtaaatattttcagccaaattagaaaagcattggggctgtagtcaaaggaaggtccaatggctgatgaagaatacagtaaaattgaagttcattagcctgggcctaagatgcccaccttcccaaagctaattcccagtgatccctagactcagcctaacaggctacacaaaacactatcaaggtggcctctggtgcctatgtattcctggggcaacaagaagcaaagtgacatattcataaaagatacagattgaggtgttacccaggagctaaaaattagaataaacgtaatggttccagaagacaggaatgattaaataagatatgctactgtaacacaatgactattatgcgaccatgtaagtcattagaacagaaacagaaatatacagaaacttgggggcattttcaagtcttgatgtgaggtgaaaatagcccaacaacaaatagtttgcacaccatgtttataacagtgtaaatacacatgcataaagatttgacgggaataggcaaaataataggatgttaagtggtgaaattaagagttgtctgttgttaaagacaggtttgtatcattgtttccctattaaaaatcagacttacaggtgatagtccagctttcataatattcttttttgttttgagagagagagagagtctcactctgtcacccaggctggagtgcagtggcgcaatttcggctcaccgcaacctctgcctcctgggttcaagcgattcttgtgcctcagcctcccgagtaactgggactacaggcacatgccaccacacgtggctaattttttaaatatttttagtagagacagggttcccccatgttggccaggctggtctagaactcctgacctcaggtgatccacctgcctcagagcctcccaaagtgctgggattacaggcgcgagccaccgtgcccagcccataatattctctttttcacaaaagagcttccagcaatccacataaaatcctgtacacatgatacaaattaaatacaagtatacttgtgcttatatgagtatatactaaatacactgatgtgctttatattttttagatttattgaagtaaaatttgcatacagtaaaatgtatccaattttatggataaatcaaatttttgcagttctgtgcagctagaaacacccacagtcacgtaaccaccatcataatcaagatacataagtttcccactactcccaaagttcccttgtgtcccttcgaagtcaaaacctaatcccctcacccccagcccctggccaccactgatctgtttccatacaggtttttggatatttctagaatatcatatgaagagactcacttagtatgtggccttctgagtttggcttctttcacttagcataatgtattggaaaactggagatccacccatgccattgtgtgtatttagagttaattcctttttattgctgaataatatttcactgtatggaggtaccatagtttgttgatccattctccagttcatggacattcgggttgtttctagtttgggactattatgaaaaaggccactataaacattcatgaacaagtcttcctaagacatatgtttgtatttatctggggcaaatacccaggagtgagtttgccatatcacagggtctatgtacgtttatctttattagtgggttttccattgtgtgttcataacacgatttggctctttgatatagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaaggtacgacttcgcaaactgaagtggtggtaagaggggaccctccaaagataaagatgctgctcacatgattaatatcaccaagtcttttactcccaagtaccaggtacatcatggtttctcaggttgctactctatattctgcttagaatgaggagacagatgggactgccaaatctacactaccaaccttgaggccagacattgtggctcatgcctataatcccaccactctgggaggctgaggtgggcggatcgcttgaggtcaggggtttgagactagcctggctaacatggtgaaaccccgtctctactaaaaatacaaagattagccaggcatggtgatgcgtgcctgtagtcccagctactcaggaggctgaggcaggagaatcacttgaacccaggaggtggaggttgcagtgagccaagatggcaccactgtactccagcctgggaggcagagtgagactctgtctcaaaaaaaaaaaaaaacaaaaacaaaaacaaggctgggcgcgatggctcacgcctgtaatcccaacattttgggaggccgaggcgtgtggatcacgaggtcaggagatcgagaccatcctggccaacatggtgaaaccccgtctctactaaaatacaaaaaattagctgggtgtggtggtgtgcatctgtagtcccagctacttgagaggctgaggtagtagaattgcttgaacccaggaggcagaggttgcagtgagccgagatcacgccactgcaccccagcctggcaacagagcgagactccgtctcaaaataaataaataaataaataataaactgccaacctttctttacagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtacatcataattgatggcagaaaaaaacattctcttgtgtgtgattgtagtccccattgtatttcatgattgaggcaattactgcttatagtcaggggtgatattcaaaatatttggcatctagaacagtgaggcaccatagaatcaagccgggtgccatggctcacacctgtaatcccagcactttgggaggccaaggcaagtggatcactggaggtcaggagttcaagaccagcctggacaacatggtgaaaccccatctctactaaaaatacaaaaattagccgggcgtggtggcatccacttgtaatcccaactactcaggaggctgaggcaggagaattgcttgaactcgggaggcagaggttgcagtgagccaagattgcaccactgcactccagcctgagcgacagagtaatattccgtctcaaaaaaaaaaaaaaagacgttggtcttggctggtacaggatgtcagaggtcccccttacaccttgcgttaaccctttagcagctgaattttggaatgtggcatgggtggtatccagcagagggttctaggcaattgggagagtaggcaggggtgtcagctacttaacatcacatttcgatattataacaagtgttagaactgcactgctgtatatagtggtgctgagtatcattcctgtttctagtgttttctgtccacctatttagagggattgggggctacaaacacccaaggaaaccaagtctcgctttttaattttcatagtcttccctttacaagtgtactgcacatggttctatgaggacttgactctaactggtcactaacttggtgtgtctgctgctacagtctccctggggtctgcagtcatcttgcacttttcaactatttctttgcatccttaaaatgtttcctttccttcttggaggcctcctctccttattacacttccttttttttctttttttttgagatggagtctcgctctgtcacccagggttgagtgcattggtgcgatcttggctcactgcagcctccgcctcccgggttcaagatactcccctgcctcagtctcccaggtagctaggattacaggcgcctgccaccacacccggctaatttttgtatttttagtagagacagggctgcgccatgttggccaggctggtcttaaactcctgacctcaggtgatcctcccgactcggcctcccaaagtgttgggattacaggtgtgagccgccgtgcccagcctatacttcctttctttaatttagtagcaaccagaggaatagaagtagaagctattttgcatagagatgccgcaggtcaggtccttacagaaccctgcgttttaattattaggctggtgcaaaagtaattgtggtttttatctttttttaaaaaaaaaatggcacatactgcaattacttttgcaccaacttaatagatgtgttttccatctcattatactagctccagacatttattcttatcttccacttgattttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgccaagcactatcctaagcagttacaaatgttaactctaatcctctcaacaaccctgagaggaaggaactattattatcccattttacagatgaagccatggaggcgcagagagacgttaagtgacttgcttggggacacacggcttaaatggcttaatgctatgttctctttaaagattcacaaaatcctgttgtgtcaatctgtgcgctttagctcagtatttagagcattgtattgtagaacaagctctgtttctctgattgtgatcccttgggaaagtcactttcctccttgtccctcgatttctgacctatattgtaagataaacaatgtggactgaatattccttagtgttccttctagctctaaaactctgacaatatctcatttacccttgccatcttgatgtgccaggatccttccctggagaacctctctctgatcagctacgtcatatcatcgagtgttgcaaacctgaccgtcaggaacttgacaagaaacgtgacagtcacattaaagcacatcaacccgagccaggtggggagaggccagtgccgtctgttcattgaccaggaacaccttgtacaaactatgcttgtaaggcatggccggcaaaaggcagatcaggcagaaagaaccttcagctcagctggagtagtttgcaggactagaatcacatctctccattggattttaacacacttaataattgaccagggcaggtgcagtggttcatgctgtcatcccagcactttgagaggctgaggcgggcagattgtctgagctcaggagtttgagaccagcctgggcaacatggcaaaaccccatctttgcaaaagatacaaaaattagctgggcgtggtggcaggctcctgtaattccagctacttggagggctgaggcgggaggatcacgagcccgggagctcaaggctgcagtgagctatgttggggccactgcattccagcttgggtgacaaagtgagaccctgtctcaaaaaaaaaaaaaaaaaaaaaaattgaccacctaatttccaggaagaattggtgcaaaagcaagctcttaacaactgtgaaatatcagatatcagtgtgtgtggatctgtggctgcaggtctgattctcagctcagttcacactaagcatcatctacgacctcactactcacagtgtggtccacagacccacagcatcagcatcacctgggagtttgctagaaatgcagagtctcaggccctaacccagacccactgagtcagaatgtgcattttcacaaggccccaaagtgattcctatgcacgattgatgagcttaagaagtgctggtctatttagggcttacttgcttctagggaccatataaaataagaactctctaaaaattaagcctaagattctgaaatttaaaaaaaaccacagttttttttcttttcaaatacctttcagttttgctttttttttttttagttcagtaaattaattatgtgtgatttatctttctaccacaggatgagttaacagtgagatgtgtattttgggacttgggcagaaatggtaagttccagtcataaccttttcaaactcttgagtgggttaattggggagggtgtgaagtcactggtgctgtggccttgctgatgggacagatgttcttcccaatgccaacaggtggcagaggaggctggtcagacaatggctgctctgtcaaagacaggagattgaatgaaaccatctgtacctgtagccatctaacaagcttcggcgttctgctggtaatatgcctgtgccacgtggccttaaattctgagtctgaggggtagctgggcatcacactacaatgtctaatctgatggatggataaccgtgacagatcagcagatatgatattgtggctgatttatacaccaatgagattgctctttgctgggcatggtggctcacgcctgtaatcccagcactttgggaggccaaggtgggtggatcacttgaggtcaggagttcgagaccagcctggccaacatggcgaaaccccgtctctactaaaaatacaaaattagctgggtgtggtggtgcgtacctgtagtcccagctactcaggaggctgaggcaggataatcgcttgatcctgggaggcagaggttgcagtaagccgaaatcacaccattgtactccagtctgggcaacagagagagacgccatctcaaaaaaaaaaaaaaaaagagagagagattcctcttctaataagcaaatgcacctgaaggaaaatacctgaacatgaaagacaagtattttttcacattctctttttacatttaagtttttctcttttaaataattaagagaactaaggaattcagattaggatgagtaataaaaattgtttagtttgcaatgcactttaagatttttacaaaacactttgacataaatgctcttatttaatcatcccaacagtcctgcaagataggtagaatggggagttgctattgtcattttattaaaatcagaattaagactctcttgttagatagttgcccacagtcatagaactaagaaatgtaagaggcaggagctaaattgcagtctttaggctcctagtccagttcctttccattgcactataatgcagtgatcaagtatgtgggctttggagtgtgccagacctgaatttgaatcttggcttctccactttctatctgtgtgtccttgagcaagttacttaacctctctgtgtctgtctctgtttccttatctttacctgatagtaataattgtgcctacctcataggtttgttgaatagactatgaatggatccctagaatacttgatacatcataagtcttgtatttatttaaaaatatttgattattaaaagcaatatttcattttccaggacctatctaggacatctgtgctgcctgctcaaatgatggctctgacgttcattacatatattggttgtgggctttcatcaatttttctgtcagtgactcttgtaacctacatagcttttgagtgagtatccacaaccggaaatttggatttaggactcagcactcacctccattgccaacatttattaactaagccctttcctcggcctgccttaccctgtacacccagctagtggagcatccatgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaatagatattcagtgagtgtagctctgcagcaagaatgccattctaaaaaacagcctttccttcttggcttaccagacaggtccctttggttgctttttgggggtaattccaacaaattctaatggaaaagaaggacatgggcatttttattgcattaacgaatcgaaacaatatgtaggttcttggatttagattttggacactgatcaggaaatgtaaaaatttattttcagtgccaaagttagggtctagctgtgactacggatcttctagtgagcctttggaaatattattagtgagactaaataaccagaaggccagccattactcagaatgatttcatcggatctaattttgcatgcataaacatgaacatgtcatcaattagctggcttctcctatgctattacatttagctgtagtttaaactcttctttccatgatctcattttacctaataacatacaataatatgggaatcttggttaaattttgaagatctgaatatagcagactccatgagaagcagcaccaatgcttccgaaagtagtctgggagaaatagggcgagtgcttagtagagtctactacaaactatttaaaagtatgcgtcaacagtcagcatgtaaaaggtcccacagaaatacagacacaaattctccttatggttatcacagatgattctgtttagatttttcctttgttgttgttggttttaagctcccccccaccccatatacacatatactcaaacagaggaaatttatgcatatagacatttaccaaagaataaaaataaattgcttaaaactcaaagagcctgacagatatgcttacataagggttggtgctaggtgtggtaactcatgcctgtaatcccaacactttgggaagccagggcagcaggattgcttgagcccaggagtttgaggccagcctaggcaacatggcgaaaccgtgtctctacaaaaaaaataagggtgtggtagagagcgcctgtagtcccagccactcaggagactgaggtgggaagatcgcttgagcccaggaggcagaggttgcagtgacctgagatcacgctactgcactccagcctgggtgacagagccagaccttatcttaaaccaaaaaaaagttggagggttggcagagtagaatgctcattcttgttctcatcctttccttttagaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggtatgtataagcttgcctgcatgttgcctggactttctctgccttttctctagtgttttgatttttgagcaggtggaaacgatgaagcagatcacattcagcaagtttctaaaacagctttatactcttacatgtgcactgcccgaagagcaactttgtcaagtctccttctaggacacctgtttatttctttggatttgttatgaatatggaattcctcaaggttgaaccatgaatcctctttgtatctccaggaactagaatttggggctggcacagaaggtgctcaatatattgaaaacattagcttggggtggtaatatattgaaaacattagcttggtggtaaagagcccaaactctcagtccctgagctcccagccagcctcattctactttgtacctcccagatatcagacacgtatgacagtatgctaagaagggcagagtgagagaatgtacatataaaacccattgtaacttcactgccacgtgggcatgacatttcagattgtgcagcctattggtggcaggtcgcaaggccttaggctccccaaatatgttgaagatttcttcattcaatttcccacccaatgcaggagcctcttcaaccctcaactccacctgacttatccttgactaaagataatctaacttctgcttgaatacttctattactggggagttcatgaccttacaaggcagccaataaccattttataaagctctacagttctgattttccattaagttcagttggctccctggtggcacttaccagtggttttgctcaggcagaaaacagtaagttgatacctcttctgccagagagtcctttagataatctacaagtaatatataacagtgtgtataatcccctgtttttcacacaagtgaccccatgcaagataagccagtgaggtgagccaggcagtcatcccaaatgtaggtgaagaaactggctccaagtgatgatgtgatatccccccaattcacaaagctagaaaacagcaagcctggctctccgtctccttatatgcagccttctgccatccccccaaccagactgcctctattttcaggctaaatattcctacacatcaagattgaaagcacaccaccacccttgccaccctgccttctatcttatgtcactatgtctttgtgaagaacaacagaacaacaccctttccctgtttgtcccagaaacataagtcaacgctccagatactgggcacggattctgtcttctttagagaaggctgaaagtcagattcctttcttaagtatgaggcccccacccccaatgttttatttttaacaaagtgtctcacttagaaaattatcatatgtcagggtcaccagaaggtacaagcgcaaaggcattaaatgaactattagatttgattttaccaggcactgcaactggtctgtgacaaggaattgtttgttctttaccagagccttgagataggacgtctgctggtcagtgtgcagagtgtggggcggtggcatggggctggcgggtgatggtgtgcagtggtgaataggattctttccccaccaaaagccattttaaacttgggggacccttctcatggtaccttctctgaagggaagtgtccgtgggctctcaacagagccagcatagtagcagtcaccaccccctggatcagccaggacagaaccctccatccttcactgggtctcaaagtcttcaaattgaggacttttggtttcataatgaaagatttgccaggagttgctgactcttaaatatacattccagacatgtataagttaaaggcacaacgctgggtgcagtggctcatgcctgtaatcccagcactttgggaggccgaggtgggcggatcacctgaggtcaggagttcgagaccagcctagccaacatggtgaaaccccgtctctactaaaaatacaaaaattagccaggtgtggtggtgcacacctgtaatcccagctacttgggaggctgaggcacaagaatcgcttgaacccgggaggcggaggcggaggttgcagtgagccgagattgtgccactgcactctagcctgggtgacagaggggggccgggtggggggtggggagttaaaggcaacactggcagctgtaacagattcaccttgaaatctcagtagaagatcatttctcactcacctacagtctagttagcaggggcagaggagtccctggtcttgcagttattcagggatccaagctattgaagactctgcctcaaggttgccctaagtttgcaggcaaaaagaaagtagaggatctcacaggaggtttctatggggcaggcctggaagtggagcaaatcacttgtgcccgtatcccatgggcccaaagtgagccatgtggccacacacacccagctgcctgggaggctgggagcatccagtcatgtgccaaagaggaaaagaaaccagcctggtgaacagctagccagtctctgctacaagatgtaaataggatgtgatctctagtcttgtcacccactttggttattagaactaggtgtgaccagccgggtgcggtggctcacgcctgcaatcccagcactttgggagaccgaggcgggcagatcacgaggtcaggagatcgagaccatcctggctaacatggtgaaaccccgtctctacgaaaaatacaaaacaaaaattagccaggcatggtggcacgcgcctgtaatcccagctactagggaggctgaggcaggagaatcacttgaacccaggaggcggaggttgcagtgagccgagatcgcaccactgcactccagcctgggtgacagagcaagaatccgtctcaaaaaaaaaaaaaaaaaaaattaggtgtgaccaatgtttcccatcttccaggggtaccagctgtggttgtgaccatcatcctgactatatccccagataactatgggcttggatcctatgggaaattccccaatggttcaccggatgacttgtgagtacaaagccccctaagggaatgctaagtgaactggaaaacggaatgctcctagaaaacggaggatctaatcagcatattgactcctgctatcatcctaataaaacccagcaatacttcacagcagccttcacagtcatatgtaatgagagaagctagctggaaatgccatgctactcttcaagtgatgaattaggagctattctgaaaagaaaaatgaattaggaagaactattttgaaaatattttcattagcctctgataaaatgacattccagttatattaataaagactcatagaacagagttgctaggatttacaggggcaaaatcctgaatgtttaaaaaaaggtctatttttaaaatactttaaatcaccaagtgtcctcaaataaactcttagattattttccctagagctataaatggttgtagagaatagcagttttatcattttttttctcttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagagatgttgggggtttggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaaaaaaaaaaaaaaaaaaaagtactatctgtgaaaccccatgaggtatgcttgtatatgcaaagtagcttatttagtggcttatgatattttcattgaaaaacatatttattattgagagggagtgctttgagatccttggaggaaaggtgcttactaaattcaagaaatggtgtttttttctccttattcatagttgtctccttggagagaccatattgaggggaacctgccaggaacactttttgaaaaagtcaattattcttccttcacttggtttcttttaaaaaaaaaaacttttgtattcaagtagaacatgcagactgtaagcacacataccatgactgtgcctgtgggagctcaccactctcccctcctaggtcagcgatttggagacaatgagaaatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgctgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctgtttctctcctaatgcaaccaatggtcgacttccagggtgacaaatgaatgaagctgtgtaatattcagacatgggtcttgacggtgggcacatataccctactagaagcaaaactgttttgtttgtttgttttttgagatggagtctcgctctgtcacccaggctggagtgcagtggagcgatctcggctcactgcaacctccgcctcccgggttcaagtgatcctcccacttcaccctcctaaagtgctgagattacaggcgtgagccaccaccacgcctggcccctggtatcttaaaatgaaggttttaaagtgaatagattgggggtttttaagtagaaagcagagaacccagaattcatccattcactcagcaaatatttattggcaaaagccttggggagtggcagccatggggctggctggggagccctggcctgccttgactgggcacctgagtgggtgagaggtggagtcccagggccccttcaggtcttcagcttgctctccatgccagcacctggggcaggtcaggaggaggcaggcaggtaggtgagtgcattgctgtactgcctgggtttgagggggagagagagatccaagcaaaggacatggcagtgggctggagaggaggagagtgggaagggaaagatgtgtggaggagatggcatttgacagagcttggaaacggattctaaatagggagggagggagaggcaggagcctaagtccaagctgggatcctgggtggatggcttgtaattccaagatacggaaggccaaggacaggatgtgggaggagacagtgaatttaattgtggaaatgcaaagttatgattccttttatcatataaatattcttaatcttacaaagattttctaaaggcattcattccccgatgccttttgacagcaagctttcctaggactctgaactttttattcaatttgcaaaatttcatgttgcccacagctgccaaaataattattaatatcttttgtgcaaagtgagcttatgacattcagctattagcttggaattcattgtgggttttttttccctccttaggatttttcatattcatcttttactgtgtggccaaagaaaatgtcaggaagcaatggaggcggtatctttgttgtggaaagttacggctggctgaaaattctggtaaagatttacctcactttttctcttcctcttaaatctcaaggaaaagattgtataaattaagatccaaagcaaatccaatctagaaatcagtgaattccagcaaatctggaatttgctcaacagaaaatattgatcgtgaacattagggagaaaaaaaaatctagtgaattaaaaaataattatttctatctgggaattttttgagcaataaaattgatgggctggctgcctcttcaatgaagcaacagtaaaatttttagaattgattttctattgagattatgcttttcatttcccaaagtaatttttaatatttaccttggtaatttttaaaatctcaactcaatcctttctccacaggtcctggttgtcagttgctttatttgttagtaagccagactttgtgtataagctttagcatacatttggttgtaacatacatttgtttattttgaagtgattttcacatatacccggttgggtagtagagcaaatagctcattttttttttttaagaaaatgagaaaaatgaagtactgtttgaaaagctacattccttttgcatgaataccacctttgcagtatctgggcgacacgggagtctgtattcagaaaatggcagtacacatagttcaatcattttcatggagtgaagaacaattagtcattacaacacagactatttgtgttcttgttaagacagtgtgaggctctgaatcactacctaattctatggatatttatagacataatcaaattagcttggcctttagttctaggagaatataggttacttttaaccccacagtcatttgaaggacaaatgtaaataatccaaatgaaaatacatgttatcacaccaactggtggaaggtgacttctccataagatcctgaagtgagaaatcagttgcttaggacttgttacactgtgatctgtctcttgcgtttgagcttcaacatactgccctgtttttctgtaatgcttattctgctgtagactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggtatgtatgtctcaatatagtatttctcaagctagtgtttattttttaaaatagttttatcctttattggcattttggctaagcaaagtgagtaactattaatacatatatgactagtggatcaaaatgtggttcccttacagaagagaaagtttactaatccaaattgatttattatagagcaaatactggaacaacgattttttaagatttggtttttcatagtgggaattgatgatgacctaaaaattttaacattttaaatcctcacttaactattgtccaaagacttcagtattgtgctatttctgtgagagcagtacctaaaatagctgataagactatagcaatttttattacatctatcataatatacatgttcaacattttttttttttgagatggagtctcactcttgttgcccaggctggagtgcaatggtgcaatctcagctcactgcaacctccacctcctgggttccagcaattctgcctcagcctcccgagtagctggaattacaggtgacctacaggtgaccgccacgatgcccagctaatttttgtatttttagtagagacaggtttcaccatgttggccaggctagtctcgagctcctgaccacaagtgatttgcccacctcggcctcccaaagtgctgggattacaggtgtgagccaccgcgcccagccaacacttttaaaccttcctattttttgcttttcatgtttgttaattctttcccacaatgtggctgtcttgtgacagcacccaaatccccatgaatatgtcaaaatactggaagatgacttgtgaccagtattggtgaccatatatgtgaccaatatctgaacagattattgctgccatgcctcctttactcattaattctgacatttctagctaaaacttctgttacattttctttctttcataagaccaggctgttcattactcataaaagcttaccttatctatttttaccttctcttgcttcttaatatatcttttgcattcttataaaaacataagctctgctggtatagtttctccttccatggagaatttgcctgtattcattgttttaggatgttagttcttttcatgactaactcaaataaatttgtgagaaggttcatacatctaccagttttcccgtttcctgaagatgggcagtcctgctggtgtgtctagacttttttttttttttttctttttttttatgacaaggtctcctattgcccaggctggagttcagtggtatgatcacggttcactgcagcctcgacctcccaggctcaagtgatcctcccacctcagccacccgagtagctgggactgtaggagcatgccaccatggctggctaatttttttttttttttaagatgcagtcttgctgtgttgtccaggttggtctcaaactcctgggctcaagtgatcctcccgcctcagcctcccaaagtgctgggattacaggtgtgagccactgtgcccggcctgtctaggcttttaaaataccataggatgcctcaaaatcaaggtttctcaacttcaagcacaattgacattttggggctggataattcttttttgtggaattgcaggacatttagcaggatccctggactctatcaactagagccagtagcaccctgcccccagttatgacaacccaaaatgtccccagacactgccaactgtcccaggggagcggggagaagaagggagcaagattgcccccagttgagaatcactgctgtaaaagatgagaaataactgttgtatagccttagctctttactgtcgataccagaaagcaagctctgggctctacaccaaatagctctatcaggaatgattcaatgtaggtaaacagaggcgaggcagcggggagcacagctggttagtacgttagtgtgagaaagcaaattgaaaggagagacatcaaaggagcgagcagggtcatctggggctctgaatccataaaccagatttgtccatattctcgaaagagctcagagatgaagcctcacctgcctagctctatcaacatgttgtcatcctttgggaaatcagatttcatggaaacagcacattttaccacagttgtttaacacagctgatttgacacagctacttttgatgcttgacggtgaggatgggggtacattttaaggctgccaaaatggctcagtgtttaatatcacataatatgcatgtcagataaccattcctgactcctcagtccttgccccagcatctgggatagatgaggaatggaattggcaatttcaaaaaagaaagctagggctgggcgcagtggctcacacctgtaatcccagcactttgggaggctaagttaggaggatcacctgaggtcaggagttcaagaccagcctggccaacatggaaaaactccatctctaataaaaaatgtgaaaatcaaccagacgtggtggcacacacctgtagtcccagctactcaggaagctgaggcaggagaatcgcttgaacccaggagacagaagttgcagtgagcctagatctcaccactgcactccagcatgggcgacagaacgagactccgtctcaacaacaacaaaaaaagctagaagtttaatgatttattatgccagaccaaattgttcttgcaccaaaatgtcctcaagccgaaatgcctaaatccaaacagctgcctcagacagtcacatgccctatttgatctgtgtcacagatggagctacgttaaccatattcatcacctagtttgcatgaatattacacagttcagttctgagctgccttagagggtggggtaccagcagccatctcatttggtacccaggaccacaaggatcacagtttggaagcaacatcacacgtcaactccattacttctgagctgtgtgaccttggggagagcacttaatttctgaaaccttcgtttcctcatctgcaaaatggggataacagtagtacccaccctgcagggctctaaatgagataataaagtgtcccagtactgttatgatcattgttatcataatcatgtcatgaactatcaaatgggcttattattcagctttgtgtatagtctcccaatggtctaatgatcagaaggatggtgccaagtaactagaggaggccagcacctgtgctcccctataactcagggcctgcttggggtggggaaggcccacgtccaaaccaacagttacccttgagtgcccagctgctccctggcctggactctgaagttggaattggtagtttcctcttgggaatttgtcctgtcctgatttagtcagaggagctggtttaatctacaagagagatgatttcttcttgccatgactgttgtagctggttgctctggtttctctggtacaaagtttcattttataggaacctagggaaccaagaacttcctaagggtacatatggggatctctgttaacattaaccttttgggagaccaaagtattaccttagcttatattatacatatgctgctacttgaagtcaaaacatatccaaccagagttaggaagtgggccttttattaatatattaccttgcttcagattttgactgtttcattaaaaaccaaacaaaaaaaaaactgccatagagaactggtttctgaagcaatctccactttggtatgcttactttgagtggccttagggaagtaatgaaaaataaataaaatatgaacatatatcacaaatgtttttaaaaacatattttacaaatacatctttaagaataaagcaatgtctaagtttgtttgctttttaatgctttctgtggatacttcatgccacccgctttgtgtttccttatacaggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattatta

SEQ ID NO: 3172 - DNA, 133147 bp, human
cccgaggacgcgagcggcaggtaagcgctcggcgccaggacgggtctggccccttggggtcctgagacccagactcgcacagccggccacgggcgctggaggctcgggcgcagcgtctagccccggagggcggcgggccagcgggccggcgggacgaacgcgccttccgcccggctgctgttcctagccggggcccgggaacatcctgaaaggcggaggcgtagctcccagccccggggctagttccccgactgggggagcccgcgcgccgtgggaaaggaggctccaaggggagacgcgcgtctccaaaaccttcggacggagccgtactttccccaacccgcgggaaactgagccacgagcctgactcgcgcgggtggtgtgctagacgccaactcccgggagcccggctccgcgcgcctggtcgggctgcggcggtgctggcggagcgcgaacgcgcccgggccccggacggcttggggcggcaccactcggcgcggccccgaacaggtggccccgggcaccgagggacggagcggcggcccggagccagggggtgagcacgccggggaaggagggggctcgtggtctcggagtgagcgcatttcggcagggactcgagtttcgaggctccgaaacccgataaaaagtgagggggaagaagagagctgacctcccgagagccagacgaagcaggggacaggttttccgtggctgcttcgacagtgacagtctgtactgtgcacgataatcccccagggatcccgttaaaatgagattctgatcccgcaggtctggggtgggggccgagcgtctgcatttctaagaagctcccagtggctgctgatgctgttccatggaccacactttatccggcaggccctacggaagtactttttgtccagcaggctgaaaaccttaggaaaagtgggagattgggagacgaggtcctaagactttacagtatgtatagctttaatacctctttgccacctctacccccaaacgcacgcaaaaacacttgctactataaaggccaagggaaactttcccttcgccccctgaaggttcgcttgaaaaattaactgacaaagacagattgattggagaaaaggcatgcaaatgtattaatgtgtccacggggagagaacaatagagtgattacccccagccccccaatggggtacagaagcatgtagattatcttgaggttacagaaagaaaggggtctcaacgcatggccccaaacaggttatggtggtaaaagaggttgtgagagggggagaagaggaggcttggccagcaaaaatggtctggagatgtcaatgaaacctcacaggtggcagccctcagagagaataaacagtaaatgtttctttcagacctttaaaggggtcagatcctcagttaatttctcttagatctggacaagggaggacctcgataaagcctggctacatccgtgcagattctctacaaatgcaaatcttccgcaccaaggacagctttgcattagctctactggctggctttctaaatacgtcaatatttagaaatatgtcaactatttcaaaatatgtcaaagaaatatattttggggtaaaatgatttgatttccttcactactcatttaatagcgaaatattttacttttcttaccaactttctagccaaatacatgatctgatagcagggctggcttcatggacatgcatcctgcacttggtttaatgctgaaattcttaatttttgaacaaggggcctctccttttcattttgcactgggtcccacaaattatgtagctgatcctaatagtcaccatacgtggaaagagaacccattttttgatcagggtttgagatggtgggtgatggagagtagaggtttattaagggaagactagctagatgttgcagttatctccaatctttctcaactcctctttggctatctgaagagataagtctaagagcatacccaggcatgcatggtgtgacaaaatttattactttattaatatcaacagttaacagtttattaggagcttaattattgatagacaatacaattaagtttgatattgaaataattttgtaagtttattgacaagttgtgtgttattttcaaaggattggggagtctctatttagcatctcataaaattttgcttagttaagatctaagatgagctggacattgcttggtttggcagctttcacagctcaaatgcaaagctggaaaacaaaaagtggccaaattttgtagcttttcaggagtattcttttacagggcctcagcgtgatgccagcccggatcggattcccttctgcttttatcactcccacatctctgcaaggtgactttcattaaaagggggatagagcatatttagctactgaaaaacactgaagaaaggcagggccagcatcagtattttgtctgtgaagaaatcttgcccaaaaaacacagattccaggtgtgtgtatttttctagaaaaaagaaatgttggaaatacagaaaagaaaaagattgtactctaactatggatatgattttgttcagcagagggagaaaaagtcagataagtggcatttcattggcgggtttggcagggaaaggaaagctgctgtgtttttggtaccatgaacagccttccagaaatggcaaagtgagtttgctcaggtgcaaggaagagccagcaaagaagctgattttccatggctgatgtgatcattgtggggactcagagcaggacatcacgacatatgttcttggtgctttgacggctcagatgaaactgaaaaacacatttttccacttttctgcctgagcgtgccaagtcgctttcaaatacacgatccaaactgggaagagtgctattaaattaacaaaaggagggagagggaggtgtttctgtgatgtccatgattcaaaagatagaaaggagggattctgactttagttaaaacctgggagctagtttttatgcttcactgagaaaggttttcctgaccacaagataggaagaaaaaagttcttttaaaatgtttatggtttcaaaaatgtgtaggtatttaatccgcatggaatttattttgggattgtggtgtgaggtggtgggtgatggaacttaaacgggctaacatttggggaaagctatcataaaataaattcccgcaatcaaataaattgtggtaaacactgtcccattttacaaatcgatttaatggattcttcagtctactccatgtttttcaaattgaagtgtaacttattacagtaaaattcactcttttcagtgtacagttctagaagttttgacaaatgtatatagtcatgtaaccaccaccgtatcaggatgtagaagaattctaccactccaaggaattccctgttgactctttgtagtcagcctcccccaactctcagcccctggcaaccactgatttgtttgctgtccctataattttgttcttttcagaatgtcctgtaaaagaacttatgtattctgtaggcttctgagcctggcttctttcacctagcataatgcatttgaggtttatctatgttgcacggatcaatacttcattccttactgttgctgagcagtatcccaaagtttgtttatccactcaccaactattgatgattatgaataaagccaatataaatattcacatatggctttttggatgaatgtaaacttttatttcactcaggtaaacacgtagaagatggctatgttgtatgtgagctttatcaaaaactgataaccgggcacagtggctcgtgcctggattcccagctactcaggaggctaaggtgggaggatcgcttgaggccaggggttcaagaacagcctgggcaacatagcaacattcccgtccctacaaaaaaaattaaaaaattatctgggcatggtagcatgcacctgtagtccttgctactcaggaggctgaggcagacggatctcttcagccggggattttgaggctgcagtgagctatgattgggccactgcactccagcctaggcaataagagtgaaactctgtctcaaaaaagaaaaacaaaaacaaaaagaaattgtatccttttttcccacttcattttctatggtagtgagtaggaaggctatttaattgtttttctgtacatttatcttacattcaagccattttactgaacttttcttagttctaatagtttttcagttgattttcttggattttcaaagtagacagtcaaattgtctgcaaatggcaataatatagggaattttccctccaatatttttacctcattttattttcttgctttagtggctaggcttccctgtaggataatgttgagtagtagttgctactattttaccattaactattgtgcttgccatagggttctggtggctaccttaattatcctcaggatgtttcttttccattgttagcttgctaaaagtctaaaagtttaattttaaaatttcttgttctgcttggaattctttttttttttttcccattgaaagcctaagaggtttaggatcagttagtttgcttcttgactttggaagttcatattttgatctcactggaggagaagttagtgtagcattaagtcaattcattttattttattttatttagatagagtcctgctctgtcaactaggctggagagcagtggtagtaatctcggctcactgcaacctccgcctcctgggttcaggtgattctcctgcctcagcctcctgagtagctgggactatggcggcgcaccaccacacctggctaatttttgtatttttagtagagacggggttttgccatattggccaggctggtctcgaactcctgacctcaagtgatctacccggctcggcctcccaaagtgctgagattacaggcatgagccactgcgcctggtaattcattttatttagatgatgaagaacctacctttggaggtttttttaataatgttcttatttgggggaatgctgggtgtactgaggaagaaagagaatcaagagacagtttataacctactcatgtataaacaaggtagctttttctagtgttcaaactttttttgcccaccattcacaataagtacattttatatttctttttttctttcttttttttaattttttaatttttttttttgagacagagtctcactctgttgcccaggctggagtgcagtggcgcaatctcagctcactgcagcctctgcctcccaggttcaagcagttctctgcctcagcctcccgagtagctgagattgcaggtgcccgccaccacacccgactaattttttttttgtatttttagtagagacgaggtttcaccatcttggccaggttggtcttgaactcctgacctcatgatccacccgcctcggtctcccaaagtgttgggattacgggcgtgagccatcacgcctggccacattttatatttcagctcagtccaaacatacttgtatataatggaaacaaactctcacaaagtctttgtctttctcctgtgtgcaatgtattgatattttcaattatctttcatctgttctatttcattttaaactgatgatcatgattttccaaattgatttgactaccctttcatttgattttttgacccacagtttgaaaaacattgttttgtaaaactgctcatttagtttctaagtccccaaactgctggattatgtccagaaccgattcattttatatcagatcctgctatgatgcaaagtaagttcatttattatgctctgagatcagtgtaactacctatttctctcttgaattactgtgtagcctctaaaccagtctttcagtgtctacttttgaccccacagaatagccaatacatgcagtcttataagtccatgactcaaactcctctaatgacctcttcccacactttttttttttttttttttttttttgagacggaatctctgttgctgaggctggactgcagtggcgcgatcttggctcactgtaacctctgtctcatgggttcaagaaattctcctgcctcagcctccctagtagctgggactacagtttcacacctccatgcctggctaatttttatatttttagtagagtcggggttttaccatattgatcaggcttttctcgagctcttgacctcagttgatccacccacctcggcctcctatagtgctgggattacaggcatgagccactgcgcccggactttttttttctcttgagacaggatctcgttcttttgcccagactggagtgcagtgtcatgatcatggctcactgcagcctcaaccttcggtgcttaagcgatcctcccacctcaacctcctgagcagctggaggcactacaggcttgccccaccatgcctggctaatttttaaaaagtttttgtagtgacggggtctccctgtgttgcccaggctggtctcgaactcctggattcaagcaggcttcctgcctcagtctcccaaagtgctgagactacaagcatgagccactgcacccggcctgcacttttttttttcttagacgagatggggtctcagtctgtagcccaggctggagtgcagtggtgtgatcatagctcactgcagccgcaaactcctgggctcatgcaaccacacccagctaatttttgtatttttagtagggatagggtttcaccgtgttggccagtctgttgaactcctagcctcaagtgatcctcctgcctcggcctcccaaagtgctgggattataggcgggagccaccgcgccgcctcctaccacacttacaatcaatccctagggcctcactggtacctcctttactccctattctcaacttctccaaacacagcctcctccgtgcttatgttcctcacccaagccaagcgtttgctgtgctacctgcccagaacaccatttcaccagatagtttctttgtttcatctgagtcttctctaaccctcattctaaaaccgtactccccacttaccacaggaagggtccattcccttatcccacttttgttttctttatatcactgttacctgcaattatgttatttagttatttgtttactgatgctgcgtcttcttttccttcctggaatataagttccaggaaggcagggactttgtgtagtttgctcatcattgtgttgtcaggacttagaacagtgggacgtagtaggtgctttatccacgtgtcaaatgaccgaatgaatgagcctagaatatagataaaatctgacacttgtcctaagagaagtataatgtgccctgcctttctgttccaatgttagtgtggaaatttctttaggttaagcgtggagtattttaatgtaagcagttcattaaccaatacacactcacctggtatccactatatttctgacactctcgtaataataatgatagctaatatttactgagcagttactacccttattgctttacatctattaactcatttaatcctcccaacctcttgaagcaggtacaattctcatcattttacagatgaggaaactgaggtacagagaagttaagttacttgtctaaggtcatacagaaggtaagcagtaggtccggggtttgaatacagaccatctgatttcagagcctgtgttcttcatcacaagctcctagctagagcaaggagtgcgcacaattcctgacctttgtaagcctgtcacgtttatggcttagcatagtggttctcaactggaggtgatttttgcctcccaggggacatttgacaatgtcaagagacatttttagttgtcatgactggcagggtttggaggtgctactggcgcctagtggggagaggtcgaggatgctggtaaacatcctacagtgcacagcacagcaccctcaccccaacaaacagtgatccggcccaagcattaatagtgccaaggttgagaaaccctgccgtggcacagtggttctgaaagcccgctgcccactggaatcactgggggagcttgataaatcaataccgatgtccaggtcttgttcctgaccttaataaacctcaaatggaccttcaacatggcctgcagtcctaccatgcttgcctagtgggtttgtttttccattctccaaaacagttgtttgacaccttttatttcctctgcccctcctagatcagttgctgattctggctcattcaacaggagcctcctcataacccactacctggacccccaacaggcccatatttgtgcaaataaagtgttccccagtgccactgtgaagctgtgactgaaatgcccctaatggatcaaaaactggctgcttttctgggctctgggtccctcatcctctttgtcttctcagggactttttttttttttacttttttttttttttttttgagacagattcttgccccgtcgcccaggctggagtgcagtggtgcaatctcggctcactgcaacctctgcctcccgggttcaggtgattctcctgcctcagcctcctgagtagctgggaccacaggtgcccatcaccacgcctggctatttttctttgtattttcagtagagatggggttgcgccatgctggccaggttggtctcgaattcctggcctccggtgatccgcctgcctcagtctcccaaagtgctgggattacaggcgtgagccaccgcacccggccttaacgttttatttggaaataattttaaactttacaaatgagctgaacattttttttaaaaagtacaaagaacaccccatgcccttaatccagattcctctgttgttagcattttatcctgtttgctttatcatttacactcttgctcgtgtacctaggattttcctgaaccatttgaagataaatttcatgcagcaagaactttaactcctaaatccttcagtagggatttcctaagtataagaatattctctcaaataatcacagcgctgttatcaatctcagtaaatgttttgataagatactgttatctaatctgccgtttgtattccaattttgacaatagacctgataacatcctttacagcatttttttccttctagtacaggatccagtttagggttgttgcattgattgattgattgattgagataggctggagtgcggtggcacaatctcggctcactgcaacctctgcctcccaggttcaagtgattctcctgcctcagcttcccgagtagctgggactacaggcacgtaccaccactcccagctaatttttgtatttttagtagacatggggttttgccatgttggccaggctggtctcaaactcctgacctcaggtgatctgcccgcctcagcctctcaaagtgctgagattacaggcgtgagccaccgcaccggcaggtttagagttgttgcatctagttgtcatgtctcttagtctcttttagtctggaacacttctattgcctttctttgtcctttgtaacgttgattttttttttttttttggttttttttttgttgttgttgttttgtgtttgagacagagtctcaccctgtcgccaggctggagtgcagtggcgcgatctcggctcactgcaacctccatctcccgggttcaagcaattcttctgcctcaaccacccgagtagctgggattacaggcacaagccaccacacccagctaatttttgtatttttagtagagacggggttttaccatgttggccaggatggtctcgatctcttgacctcgtgatccacctgccttggcctcccaaagtgctgagtgctgggattacagacaggtgtgagccaccttacccggccttttttttttttttttaatagaacattaatcatgtctggtttgtctgatgtctcttgtgattggactcaggttatgcatttttagcctgaacactgcgtggatgacattatatccttctcagggtatcttattttggaggctcataatgtccatctcttcctcattggtgatgttaattttgatcacttggccagggcattgtctaatttctccactgtgtagttattggtttttctttccaaatccacagtctgtgggaagacacaaatatcctgctcaaaatttccctctagggccaggtgtggtggctcacgcctgtaatcccagtactttgggaggcttacttggaggatcagttgagcccaggagttccagaccagcctgggcaacatagtaagaccccgtctctacaaagaaaattaaaaaattagccaggcatggtggtatgtgccagtggccccagctacttgggaggctgaggtattaggatcacttgaacccaggagatcgaggttgcaatgaaccattatcggaccactgcactccagcctgggtgacagagcaagaccctgtctgaaaataataataataataataataattccctttagatttagcatccagtgatgatttttgtatgatctattctttaatatggttgaaaataataattttcgactctagtattccctccacatttggtccagagcccttccttctcccctatttattgattgattcatctatttatttttggtatcaaataattcatattttcaaaataggtctgcaattcattactatacttaattattttagtgcacaaattgtaaaggacttaattatgcattgtttccttctctcttttctgcctaatgaactcctctctccctgttctagatcattcccatcagcttacaatcctgctctaatgtctaatatcttcatcaattccatattctcctccactcattccccacccccatttctagtcactccttctcagaagatcttcttaaaaggatgctcatattttatcacaccacattgtcagtcctcagtatatccacattggcaaatacagccatcacttctttacttaccatgttttacttggcggcagcatttgacagtcattccctccttctttgaccactttcttgttgtggcctccagtatcctacgctctcttggttttcctatctttctggtagctcattctaagtctcctcatcctctcttctacctatgaaggttgatgtccctccaaggcactgggaactgttcttctctttctacctactctcctgggatgagcccattcattcctatggctttccattccatctagatgccagtatctccagttgtgacctttcctacacttaagacttaataatttgcatgaatctctaagaggcatctcaaactcaatattttccaaagcaaaatcctgattccctgtcaccctcatgcaaaacctgattctctccctgtgaaatccatctcagtccatgacatcaccattcactccatcgttcaggctccacacctactagtttcatgccccacatccaacccatcaacaaatcttgtcaatttggcttctaaaccgtatcccaagtcttcccacttctctctactcctactattccactatacttccatccttctccgtctctttcttggatgattgtagtggcctcctagaatccaatatccacatggcagctagagtatcttcttaaaagcattagttggattgtgtcattccctactggactatggaagtctgccatgttctagtccctgcccctcttctatctctcttgctgactgtgcttctttattgattcttccagcacattaacctcattttagtcttttatactaactgttctgcctggaatgttctttctgtcctctactttatcttctgtttttttgttttttttttttgtttgttttttgtttttttttgagatagagtctctccctgtcacctaggttggagtgcagtggcgcaatcttggctcactgcgacccctgtctcccgggttcaagtgattcttgtgcctcagcctcctgagtagctgggattataggtgcatgcaaccacacccggctaatttttgtatttttagtagagaagatggggttttgccatgttggccaggctggtctcaaactcctggcctcaagggatccacccgcctcagcctcccaaagtgctgggattacaggcatgagccaccgcgcctggtccctcctttatcttcttattgctggttcctcatcattcagatctcagtttaaatatctcctctttgatgacctgatccaaaatagccaccaggttaccttctatatcatctcaccttactctaattctcaatgctgtatttattatctgttaatttccttgttgatttgtacatttattgttctcttctcctccttccaccctcctcacactagaatgtgagcagggtccacatctttacccccagtgcctagaatagtatttggcatgtagtattcaattttggtgtttaataaatatttgatgaataaatgatacatttaatccttcatgcatgattctcagcacatggaagatactcactaaatgtcctcttgttgtctttccccaagagtacattcttgtgtctggggctagtctagaagtttccagtgaagacaatcatctgataaagagattcatatttctgtgttaggatcctgattattagggtttctagacaaaggggaattacattttaccaagaaaaaaacagtgatagaattccagggatcattagtgtcacatttttcagtgtgggactttcctggccctcctaactacaagactggttctcagattccacaaaatcgacatgttttatcttgggattctgtcgtgtaaatttttgaaacacttcatttgggaggatcacgtggatttttaggtgggaagaaggggatagcaaaggaagtggcattcttctctgcctttgttaatagtatcatttcctgtgcccatttcaacgttagctctggtataacacaagtgataagccgtgtgtgttattgaaatctgagaaaagggcaccaaaaaatgtttagtactttgtactggtctaaaattcatgacttgaatatgtggggagagagtgaggaagattgggaagatgtatactgaagtggtttccctttgaggtattatttgaagattggtgtgatttttgggaaagctcttgtagtggattttaaagcttccaggaaaaaatctgtaccaatgaacacgactaatgattttgtcagcagatgattcgctttttgacagaaatataccacatgtttttggggtatttggagaaaccatcacccttgacccagtaggatttttttttaaactgggccaaatgcttattgtattcacagttcatacatgagtcaagagctgggcgccattactcagcttgtgatattgatcacctgttcatcacgattcatcatttcaagcagccatccttatgaaagcaggcaagtgtgtcaagtagtatttcatggacatatttagagcgttcttcttcttccttcttctttcttcttcttcttcttttttgagatggggtctccctatattgcccaggctggtcttgaactcctgggctcaagtgatccttctgcctcagcctgagtgttactctctttgacttatccataaaagtggatccaatgtgtctacatatattttttaaattaaacttttattgaagtacaaattatacacattacaaatgtacagctcaatgaattttcacaaactgtgcatatccctgtcaccagcccccagatcaagaatcccacacaagcagcctttagaagccctcctcttgcctcctttcactcactgccccccaagggtgactactgttctccctcaaatgccacatattgtgcctgttcttaaatttcctatatgtggtaccagacaggctacctgacttctgctcagtattgtttgtgaatttcctccatatcgttgcatgtggttatagttgggtgattgtcactgccgaataatattccgttgcatgattaccatggtttatcctttctactgctgatggcctttgtttggtttccagcagttttggcttttatgagtggtgctgtgggtgattctcttgcctatcttgtagtgaacatatatgtgcattactaccaggtaaatacctaaaagaatgctttaaatagattattaatagtttttatggttactgtcaattattttctcctctgaatgcaattaggattagtagccacctttggacataactcacacatctgtatccatagacaatgatgagactttctttctgtaactttttttttttcttgaactcctcaagcaacctgcccgcctcagcttcctaaactgctgggattacaggcatgagccaccgcacctggctttctgtaactttttttattaagttctagcattagttgtttttacactttaattttcttttttctttttttttttttttttgagacggagtctcactgtcacccaggctggagtgctggagtgcagtggcgcgatctcggctcactgcaaccttgtgtcacctcccggagcgattctcctacctcagcctcctgagtagctgggactacaggtgcgtgccaccacacctggctaattttttgtatttttagtagagactgggtttcaccgtgttagccaggatggtctcgatctcctgactttgtgatccgcccgcctcagcctcccaaagtgctgggattacagacgtgagccaccgcgcccagcctatactttaatttttttctaataattggtttctatgctgattttttcctttaccaactacctatatcatatcatcattttaaaatatcttaagaattttagcttgctttttcttttcctgcctgcccccaccatccccacccccagctgtatttcttttgaaatgaaaaaaaaaaaaaaaacaaaaaacaaaactcctggaactgctgaatgtgttttgcagatatagaggtaaaggtttaccacccgaatagctttagaatggtacaggcttattcagcactgattcctagtcttgccaaggaaaagtaaaaaggacaaagaaaggaagaaagaaggagggttaaaaaactaaattatgctttattttgtggtgtattggttgacagtagtatttttctctgtctcctctcagctaatctggtcatttgaccaactggatagagcaaatattgtctgaaatgaagcaaatacattccatttgattttggtgggagacaaatttttaggcagggaaaacgattagcagatagtgtcatgcacagcagtgcctttcaaatgccaacatgcaaaacgattgcctggggatcttgttaaaatgcatatgcggattcagcaggtttgggactggccagagatttctgcattgcagctcctaggtgaggtgatgctgctgttggggcgggggagctgcactttgagtagcgaagctttagaacatagctgcctccatgttcctggggattatatggagcatttgcccgttgcccactgatggatgataaacagctctcccaagtacccctctgggcttgtcctctcagcactgccggcagaaccaggttgtgtgtagcctgcattaaagcagcagacaaagcccagggctcttcttttttttttgagacagagtctcactctgtcacccaggctggagtgcagtggcatgatctcggctcactgcaacctccacctcccgggttcaagtgattctcatgcctcagcctcccgagtagctgggattgtaggtgcccgccaccaccgcccagctaatttttgtatttttagtagagacggggtttcaccatgttgcccaggctggtctcgaactcctggcctcaagcgatctgcccacctcggcctcccaaagtgctgggattacaggcgtgagccactgcacccagccgcagtgctctttttttaacctggaatagcaacttctttcaaatctccctcacctggactctcctcaaatatctcataacacctgaagaaaaaccactaacctcaaacacacgccaaaccgaaacacacacacacacacacacaaacacacactatcccagatactgacatggagaaaggagtggggtggggcaggcattaagccactcttttttctcctggcttcactatcgcacacttcctcattcattccagagcaactaggtgtctgtttcaacatccctggccccaccattatagtacacaccagtcaccttccagccacgagctgcacatttctctgtgggggccctctttacacatccatgctgcaggttggaagtgccagggaattaacagctcccaccccaccccaggagcagccttcaaccaatgcctgatgcaagtcagtggatccataccctcaagtgggataattcagaccggtgttctacactggctcccagaattccccagaaggactaaactcccattgcccccagtggtgactggcttgataacgccatctattggctgccttcctgccccaactcacgtgtccattctatctgtgtttcctggggtcacagcccagataaactacttatctcgaatatgtgccaaagagttaccttcttcttcttcttctttttttttttttttttttttttgagacagagtctcgctctgtcgcttagactggagtgcagtggtgcgatcttggctcactgcaacctccgcctcccaggttcaagtgattctcccaacccagtagctggaattacaggtgcacgccaccatgctaatttttgtatttttagtagagacggggtatttcagctaatttttgtatttaaaaaaattttttttattatactttaagttctggggtacatgtgcagaacgtgcaggtttgttacataggtatacacgtgccgtggtggtttgctgcacccatcaactcatcacctacattaggtatttcttctagtgcttttcctcccctagccgcccatccccctacaggcccccgtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgcaaaggcctatttaacatggcctaaatagcaactaattatagttggatgattgtcactgccaaataatattccactgcatgactaccatggtttatcctttctactgctgatggccttgtgtataatttgtactacaataaaagtttaatttaaaaaatatacatagacacattggatccactttcatggatgagtcaaagagaataacactcaggctgaggcagaaggattgcttgagcccaggagttcaagaccagcctaggcaatatgggaagactccatctcgaagaagcagcagcagcagaaaaagaaagaaggaagaagaaatacaaaacacataatttttgtatttttagtagagacggggtttcactatgttggccaggctggtctcgaactcctggcctcaagcaatctgcctacttcggcctcctaatgtgctgggattacaggcatgagccaccacgcccagccttggagttactttttttttttttttttttttttttgagacagagtctcgctctatcacctagacgagagtgcagtggtgtgatcttggctcactgcaacctccacctctcgggttcaagcgattctgctccctcagcctcccaagtagctgggactacaggcacccgccaccacccccagctaatttttgtatttttagtagagacggggtttcaccatgttgaccaggctggtcttcaactcctggcctcactcaagtgatccacccaccttggtctcccaaaatgttgggattacaggcatgagccaccacacccagcagagttaccttctgaaggaacccaactaaggcaaaactggtcaacagtcaggaattccttttgttaattttaataaaatcctattataaaaaaagggggagccccatggggtttcttctgaggggcatctcaccagtatctagatattttgtctgcgtgacaccaaacagtcagatggctggaaataagcctgataatggagagaatgcttctctgttcccgggctgttttgggatctggtcaacagagttgattttctggacaccccagtcaagctagttcaggtctttttgacctgtacccagagggtgtatctctgagttctgcctcagaagcttgatcacatcccgggggctcctacaaaccacatcctggctgcagccaactcccttccacaggcctccctcactgagtttctctgtggtgggttctctgcatagcctcttgggatgaggagtccttctcagacctttacagaacagagcccctgacactcagtttcaagggcctacctacatccgtttccgaagctttgcatcgatggtcactgctcctcttagccatgtcctcagctttctcctcctcctgccttcttccccagactgaagtggatctgaaccttggcacaatctatgcctcttagtgcattttaggggattttagggctgcctgggcccctctatatgttcagacgtgtgataggacccagccttttcccctcaagaccttgtatttgaaattccccattctatggtttgtctcatctttggaacccacagcaggcagagatgtttgggagggtggcctcactgggcacactgtcctggatgtctcacagttttgcatacctctgccaggctgtgctgcccccaggccagactcctgtttctctgtttgggcatcttgggggtcctaattagacacttagtcctttggatttggtattttgagagtacacgtggtatcaacagggctagctttaatgttaaaacatctattaaaacaataagggtggatggctaggtgactgctactgttactaaaagaggtcccgatccagaccccaaaagagggttcttggacctcatacaagaaagaattaggagcaagtccatagagtaaagtgaaatcaagtttattaagaaagtaaaggaataaagaatgtttgctccgtaggcagagcagtggcatgggctgctcgactgagaatacttagagttatttcttgattatatgctaaacaagaggtggattattcgtgagttttctgggatggggcagggaattcccggaactgagagttcctcccctttttacactgtaaagggtaacttcctgatgttgccatggcatttgtaaaccgtcatggcgctggtgggagtgtttttagcatgctaatgcattataattagcgtataatgagcagtgaggacaaccagaggtcatttttgtcgtcatcttggtttttggtgcattttggctggcctctttaccgcatcctgttttatcagcagggtctttgtgacctgtatcttgtgccgacctcctgtctcatcctgtgactaagaatgcctaacctcctgtgaatgcagcccaacaggtctcagccttattttacccagtccctattcaagatggagtcactctggctcaaatgcctctgacactaccctgtaactttcttagtcaacttgggctgccagaacaaaataccatagattgagtggtctaaacaacagaaatttatttctcttaattctggaggccgagaagtccaagatcaagatgctggcatggtcaggttctggtgagttccctcttctgggtttatagacagctgccttctcactgtgtcctcagttggcagagagaggtgggggaagcggggagggagagggagagggagagacaggttaccctgggggttagggcttcaaaatatgaatttggcaggagggacacacaagtccacagcaataactgtgcatgactccacccccatctccccacccccaccagtatctcatctgttgatctggctgaaatctgaaattccacaattagagattcatttccttggtttaaagtgttataatttaaatgagcacagaacctggtcgatgggcctccatgcgaggccttctcctgagagccagtgaaaaagtatgaggtcactgggcacctacaagttgggaatggcccccacctagaagacacaaagagtactaaagaggaaattgattttcttcaagtgaggtgggcttgttaactttgccaaggcctgtcctagtcctcagagttatgttcatatcagttcctgcaaaataccccttaaaataagagaaatgagtccttcatcttgcttttttgcatctatgagtgatgtgaaagacattgccttttaaagagggagtccaggccgggcgtggtggctcacacctgtaatcccagcactttggtcttgaactcctgggctcaagtgatctgcctgccttggcctcccaaagtgctgggattacaggtgtgagccaccacacccggcaatattttcaccgcaatacttcatcttcctcccctactaacatccaaatggtacctgaagtaaagcgagccacttcttatggcttgttattgctgggaacagctgcttgtggataattagctcaggcaatcagaacactgggtcaggaaatcaggcacgtgggtctgactcctgtatggcctttgctcttggggacctgttgagggtgggtcactgctggttcagtatgtgctgcatgtggaattccatcccctttgaacctgtaccattaatggggtaacagctggaggtgcttaactttggccctgcatcagttttcaaaagtgcataaaggtaagcactatcctgaaactgttgtttatctttctcatacatttctttttttttttgagattgcgtctcactctatggcccaggctggagtgcagtagctccatcccagctcactgcagccttggcctcctaggctcaaatgatcctcccatctcagcctcccaagtagctgagactacaggtgcacaccactagggtcggctaatttttgtattttttgtagagaaagagtttcaccatgttgcccagactggtctcgaactcctagactcaagtgattcgcccacctcggcctcccaaagtgctgggattacaggcgtgagccaccgtgcctggctatccttctaatacatttctttatattttcctacataggaatatgtccttaagcaagagagaatgctactcgcatgccttttaagctttataagattggtgtgttttttactttcacattttgcaactttcatctcatttaatactatttttgtgagattgattctcttggctacatgtagctctagctcatttttcttcctttgctttatccacaaaccactcccagagaacaactgaactcacagttgccagggtgggggaagagcaggaattacacacacacacacacacacacacacacacacacacacacacaatctcatgattagttgatttgaaacacacctcaagctattctcataactaaatcttaatccaaccaataattcctttagattttaaccacttaactttggaaattgttttataaagctctagttcttccatatgttcacaactcacaaaattggttttgcaaataatccttttaccctttgcccgcgaggaatcgcaaagctgagtttgctttcatttgccatcgcttttcttcccgttttcagatgtcgttatctttctgtttccttttttacttggcatagatttgccttcctttcccaatagtatgtccaactctttcaaaacctctccattcattcagccatgcattcttttcacatatgtttataacatccctagtatgtgccaggcacttttgcaggcactggggactcaacagtaaaccaagcagacaaaacttctgccttcggcaaagaagcttatcttccagtgagtgaagcagacggtatttgagtaaaatacacggtcagttagatggtgttaggtggtgtctgtggaggaaaatgaatcttgggaaagaggcacaggaagccgtgaggggttgcaattttatatagcatttttctaggccaggggttggcaaaccatggcccaaggccctccatctgtttctgtaaatgaaggtttattggaacagagtcacgctcattcacttacatgttttccatggctgcttttgcattgcaacagcagagttcagtcattgcaatggagaccattttggctgcaaagcctaaaatagttcatatttggccttttacagaaaatatttactatttgaccctttgcagaggaaatgcagatttttacctatgataacttttgaggattctacccatgttgtgcttttcagcttctaaagcgttgtcaggaacacgatgtcatctgagtgttgaagtagtgtttgttatgaggtaggtctcagtagctttgttttacaggtgactcaactgaggcttgaaggggttattatggttgtccagggttgctgaccttgtaaagtggtcgtgttttttggtgtttttttgagacagggtcttgctctgttgtccaggctggatgcagtggcatgatcatggctcactgcagcctcaacctcctgggctcaagtgatcctcccacctcagcctcccaagtagctggaaccacaggcatacacaaccatgcccagctaatttttgaattttttgtagagatggggtttctctatgttgcccaggctggtctcaaatccctgggttcaagggatcctttcagctcaggctcccaaaatgttgggattacaggcatcagccactgtgcctggcctaatgctggtgttcaactctaaaagctggtgcgttttctactttccagtgacaaatacaacccaggtttttagcgtgacgagcttctaagcacatgaaacacagataggcaatcacgtgtaggtgtcacgaatgtgggctcagaagctcagcagcccaagttcaaatgcttgttctgccacttacctttgtgacatcaggcaagttatttaacctctctgtgccctgcctcagtttccttgtctgtaaagcagtcataattgtatgccttctaggtcaggtggtgctgtatcttggttttgccaaggcagctctgatttatgcctgttttttccacattaatcaatagtgccccattttactctcacatacccccatttggacattaaattatgtgcatgccctaaccagggtcgttgcagagattaagtgagttaatacaaataaagcaagttaatacaaataaagcagttcaatccatgctgtaggaagcatttgctagactttggctgttgtttcttgtcaaggccatgccagcccatcacttaatttttttttttttaacttttttagatggagtctcgctctatcgcccaggctggagtgcagtggcgcgatctcagctcactgcaacctccacctcctgggttcaagcagttctcctgccttaccctccagagaagctgggattacaggcgcctgctaccacgcctggctaatttttgtattttagtagagatggggtttcaccatgttagccaggctggtctcgaactcctgacctcaagtgatctacctgccttggcctcccaaagtgctgggattataggcatgagctactgtacctggcctcacttaattttcttctgacccattgctttgtcccattaagtctgaactgatttctgtctggagcaattttgcttatctgggttaataggtgattgaggattcatcttctgtgtggcagtgccttctggctcactccctgacctcccttagcagctttgctcagatgtcatcttctcatgatggtgtcacaggacacctctctaaaattgctacctcccccacctccaacacacttcatatccacttctctgctttatgtgtttgctttatagttattactaacatacaggttttactgagctactactgatgtggttctgttttgctgttacttggataaaaaaaaaatcctacaaaatctgctatgcctgtgagaatatttatttttatgttttaaaaaaatgtatctttatcattacattttcagaaattacagaaaaacccagtaaaaaattcagcccacccatggtcccccctccagttggcattttgctgtgtatcaagaatacagcaattttaccccacctctagagggagtacattttctaatctaaccatataactttagctaaacagcttacaagcaaatgacagtttactatgttctctaagtattattttgattcctttaaaaggagatttttcctacacattttcatctgaagctggcctaggaggaaatataaacacactggtctagcctagtcccatctctagaagtaaaggaaaaaaaaaacatagaagagaaattgagtgaaaaggcatgttccctcacttgcagttagctttctggcacggtggcaaagcattggcctggcgcctgccaaaatgagcatcttaatagaaattatcatgtgtgacattcctttgaattgctaactttctttgtaatattgagcaagttgctttttgcatcattgatataattcatcttcttatgtgtttgctttatagctctctttaaaactgtcagtgtttcacagattgatccatttgcgtttttatttgtttgaatgccgcactggcacgtacaacccaaaagggcacagttgtgtgtgtcttgttcaccactgcactcctagcacctcccgtagtgcctagcacatggtatttacttaataaatatttgttgaatgggaaggtgcctgagcacagcagagtacgctcaccctcgatgcagtgagggtgtcctgccaccggggccggggtggggaggagatgacccagtataaggtcctcagctgcgagagaatgaacctccaaaatgtggtcttggtccctcaaatagcattcacactttctcccccaggccccggattcctgtaacaaaggataagtcattaattcagtcctccgagttggtttaaagaacagatgcctttgttttttttgagacggagtctcaccctgttgctcaggctaaagtgcagtggcgctatctcggttcacttcaacctccacctcccggattgaagcgattctcctgcctcagcctccccagtagctgggattacaggcacctgctaccacgcctggctaatttttgtattttagtagagatggggttttgccatgttggccaggctggtctcgaactcctgacctcaagtgatccacccgccttggcctcccaaagtgctgagattacaggcgtaagccacaacgcctggccaaagaagagataccttttgagagaggaagctcaataggaccttcacacgaagaggtcaggtgtgatattagctccattcctgggacagctgtgatcaagtgggagcggaaagaagagcataaggaggggaggcagagaggggctgggtggagtggcatggccaaggaggaaaacatgcaggaagggcagcaggcccatgccagacctcttctcttctagaaaagcacatgaagtgtcagccacagagatgtatgtggagcaatttgcagagtgcctggtgcccggaagcagttaacgatggcactaacactcacagctaatatttttgagcatgtgctctaagccaaagtctgctaagcactttccctgtactgactgactcattactcataagaattttaggacataaataagaagtttatccccatttgatgggtaaagaatcccaggtatggaggcagtaaatatcagcaactactttatcccatgacttgtgataggctacaattaaacactggctgttatcatcatgactcactgaaaatacctcaccacctccctacacctcccttttttctgtaatagtgaaaaggctttgacaatgttgtcaataatgtggcattagtactataggataaccaaaagcagcttgtaatatttatggcaagggagttttaaaagatcttttgagatattgtacacttgttcttacttgcatgagcacattacatttttatccaggcagaatcatttttctatcaaatggtagttttcaacctattgctaactgcaatactgattttttttttttttttttttagatagagtctcgctctgtcacccaggctggagtacagtggcgcaatcttggctcactgcagcctccacctcctgggttcaagcaattctccctgcctcagcctctcaagtacctgggattacaggcacatgctaccatgcctggctaatttttttatttttggtagagacagggtttcaccatgttggccaggctggtctcaaactcctgacctcaggtgatccgcctgactcagcctcccaaagtgttgggattacaggcgtgagccaccgcacctggcctggtccatttccttttaaccctgcctttccaatgagaacctgggagatgattaaaatattccattttatatgtacactgcactttaaaaatttttttaatttaattttttgagacaagggctccctctgttgcccaggctggagtgcagtggcacagtctttgttcactgcagcctcaacctcctggactcaagcaatcctcccatctcagcctcccaagtagctggggctactggcacatgcccccacacccagctaatttctgtattttttattgagatgggggagggtctcactatgttgcccaggctggactccaactcctggactcgagtgatcctcccaccttggcctcccaaagtgctgggataacaggtgtgagccattgcgcctggctccccggcactgtttttactataaaatttttcagctgtccccgagactagattatgtgattactttattttggatgagagaattgatgtttactttttcctcagcattctatttatcattctaattaacaagttaccagtttcactaataaaatgcttttggcatttgatatgctgattagcgaagtgtggattgtaggtcaaggtcacaatggcagaaggacgtgtaggagctgccttgagagagtggcctttgtgctataaagtttgcagagcactcatcgagttcaagcttaaactcaccggcacacacaaacatcacactgccttccctgcggtatattaaagtgagttccagacctcataacaggcaggcccggggcacctcatggttcatggaggctttggggtacagtggcaagtgattagctttgggagtaacatgactcatgtagtctcccgttttctcaaattatctggtgagttagtctcttactgcaagggaaaaaataatactcccacaccacttggaacaccccagttttgggaaaatcactcaaaaaatgctgcttagccacccatgcagcatccgtgctgctggagggtcatttgggaaaaggcagcgtccagacgcctgcgggaggcaggatttttatgggctgtttttgtgtccagtttcgtagttttcagaggagtccattcaggctgtcaatgggaaccgttgaacctgtcaagttgctgtttgccgggtctcttggaaaaacacactgcaacatcccagccctgggcgggtcagagaggatagtactaaaaaaagaaggagaaagtggacggccccgctctggtgggaggccagggcttggggctgcagccaagttccctggtgatagaggagtttccaccatccaaggcttcccgttctggctccctccaccctaccgtacaccatccagccttccaaaataactccgcttccggtggaaccgggcagagtcactggaatgcgtggtaagcagaaggagcaggtagagttgatgctgggagagaaagtgttttgatgagcaaggaaagaaagtcgaacaggaaggccagccagccactgcaagactttcctggcagtaggaacactgatgggaatggcactgacttccagtttctgaggcgcagcccagcaaacccatcaaggtaggcaaagcccttccttgggagtcatccccatacctcctcctcctctctctcccagttaacagcaggccttcccatcccaatgtgcgtgcgttgtccatgcctgacctcactgggctctgcctggtcactgaggcctgctgtatccctgttcaccacccaaactgacctgatcattaaaaaaaaaatagatttaggaggtacaattgcagctttgttacatgaaggtattgtgtattggtgaagtctgggctttgagtgtaaccatcaccaggatagtgtacattatagccgttaggtaatttctcacccctcacctacctctcaccctccctgctttctatccatactgtatgtccatctatccatactctgtgtccatctatccatactctatgtctatccatactctatatccatctatccacactctatgttgatctatccatactctatgtccatgtcacattatttacctcccaattataagtaagaacatgcagtatttggctttctgtttctgagttaagataatggcctccagtttcatccatgttgctgcaaaggacatgatttcattctttttcatggctgggtagtattccatggggtgtgtgtgtgtgtgtgtgtgtgtgtgtgtgtgtgtatacctacataccacatttatgtccaccattgatagacacttaggttgattccatatctttgctattgtgaatagtctgacttgataaattaagtcacacgtgcccattagtgaccacagtcattgaaatttgcatgttttattgggtgcaagcccttaccaaaaaaacaaccaaacaaaaacagaaacaagccttgagaggtggtctcttagatactagtcaaaaattaaaaacaacttttggggtggaggaggagtcctactctagtgaagtcttaatagactctaggtcaccgtcatcttcagattctctggtatagaacatgtttacatgctccctgcccgccatctccccaaacacacaaaagatagaatcagtcactcccatctttgtgtcctcaaagcagtgttcttatgaccatgagcacgttttctcccactgttcatccacgcataggagtgaacatgtgagtttcttgccttctcagaacgttcccctttatcctctccttgtgcacacagactggcctccatttagaagaggggctcagtcaagggccacaacttcctgcagactgtgggatctaccattcaagactgctgagaggaggagtaacctgagatctgagaattgtgccaaggtggaagttatgaccttgataagaataacacaaaagcccgattgaaatcagttcaggagacgctgggaagaggaagtggaggtgctgagtgtggccaaaccctgagcaggttagttgaggactagctaagaggaaaagcttggccttctctaaggattgtcatgttttctcttgttcatggatgagatttcagaataaaacacgatccccttttctatttgggcaccaaagagccatgtttgtagtttgttaatataaaggtgaaggccttgtgacctacttacctacttcctaacttcccagtttccctccttggtcctgatctccttctgtaatttatattctccttgatcctgcctttctttgcagggagtgaggaggggaatacaaagtgccgttttgtcatctgtggtcttggttgttaattgcctgttagccttcacagaacaagtgcaactgaaggctctaagacacaagtcaacgtgaaggtcctcctccatctcgccagacaactcctggactaggtcctggttcaggatgggtttgtgcagttgctgcagacagaggcaaggactgaattttaagatgctgggtgaggagggtgaggctggagggtaagagcaggtaaaaagggactgtgcataccccacttggagctgcaggactgctttccctctcttgctgggccaggctatggccttcccctgcagcttgggaagttactgtcctcgcacctgcccgtttgggtttcctctccccctcctgcctttgaccctgctcctcatcctctccagacacctgactccaagctcatctttctaaagctgctctgtctggttaatttcaccccctcccccaattttattctcgcccccatcaagttaggcattgactgtctactctgctaatttgttgtcattgatacctgacttattttcaagttgttgcaggggaactgatgtgagggaaaaagctggaaggtgttgttaactctgtagaaattgtatgtgactatgaaggccaaaagcatttcgagaaagcatcccatacacttgtaacctagcagcagtgggatgctgggatgctgcaagggctgggatcaaaggctgtggattgggctggcagagggccggtggctgtggtgggaaggcacaccagacccaaggggtggacaagttgtcagatgacctggattctagttcacatgcagctgcttcactgcgtttgatcctcacttgccttagctgaactctaggcagtgcctgccactctttcactctttatatccaacccagacccaagtcgcgtcaattcttcctcccaaatactgctcagtatgtccatcattcatcaccaccaccaccatcttcatccagccttgtttctcacctcgaataccgtaattacttcctcgttggtagagagcagggcaaactagcgcccacaggccaaatcccacaagctgcctgtgtttataaataaagctttattagcacacagccacactcattcatttacagattgcctgtggctgtttttgtgctgtaatggcagagttgagtaattgcaacagaaatcctgcagcctgcaaagctggaaatatttactatcttacccttgcagaaaagatctgcaggcccctggtgtagaggaaaatcatttgtataattattctgactcttcttttctgaactctaatacccattacattttaatagattttcgtgtgtgtgtgtgtgtgtgtgtgtgtgtgtgtgtgtgtgtgtgtgacataaaatctgtagtctccatttcttgattctaactcttactttgtatttttgttttactgaattgctcagaccttcagaacaatgtttgagaatggagagctaaaattccaaactggacccccacttccactaagaccccctcctattcattttccatgcaaaaattgctagaacaatcttgtcaaaatgtgaatctgaacacgctgcccactgtttaaaatccttcagtgactttccatggctctcaaagcaagggtgcaaatccttaccttggccaccaagcccccttgggagctgagccttttctgtctctccagcctcatctttcactgtcctctccttgccacggcatgtcctgtccactcctacctttcttcagttccttacatgagtgacattccctcttgccacagtgcctttgcacatattacttcctctacttgatacggtctttccttgcctctttggtgggcaagttcctctcacccttccagtttcagcatcacttccacagggaagccttccccagtcccttaggtcagatccccctgtcttcacccagagctcctgttgcattgctttgtggcacttgctgtaatcgcaatatcgcacttcttggtgtgaatttttgtatcatatctctgtttccccattagaatatgaacacttacccaacctcaacatctaatttgacctttctaaacattaacatcataaccacaaacaaataggttctgggacactaaggaaaaatcaacttttaaaaagtgcaaaaaaaaaatacatcattcaggagaaaaaaataagttagagtgagaataaagaataaattagaaatgtggaagaggaaagacaagcattttaagaaatgaccttctggcttctgagttgtactgagtggcttgatgtcattagcaagatgaacgtattgattttctcttatttgtatagtaaacaaatggaaatttaagcattttaccactcacagtacattgtttcctgtagttataaatatattttcttctttcttagcctgcgcagccacgtgagggagggggtcttaaaccatgcctcttaacccttgggcatctggctcgaaggcccattttcttctcctctctgctggctaggagcaatgggtagaagggagggctagaacacacttaacaggtcacagtgacaaatatttctttcagggagattatcatgagcaaatgcccagaaacgggctgcaaactctgcccagtgtccccagaaacatcttggttcatctctttatgagtagggcccatggaccatgcaaggtctgcagaatctgcttatgtgggttccagagggagtgtatagagggagtgtataaaagaaaatgaggcaggctttgaattagaatcagcccaggccagcattttatacataatgggcccttcccttaaattggtacttgtagtacttacagaaggaaaagaagaaaggaagatgagtggagagaaataatgaaaggaagaaagggtaaagaggaagggaagaaagaaggtgtataagttagttttttccacataacaaaacagcccaaaatttagcagcttaaagcaacaaccatttaattagttcacattttttgagtccacagtcttggcagggctcagcaagatggttcttctgctggtctcggttgggctcactcatgcatctgttgtcacctgccagtctaccagatgaccctttgcctgggggttggccagctcttggttggagcaatgcctgaccaggcgtgggtctttcatcatctggccaactagctcaggctggtttccactcttacatggtggcttgagccttaaagagcagcaagagagagcaaattccatgctcaagcacttttcacacttttggttgtatcacatttgctgcattcaaggggtggagcattcaaggggtagagcaacaaaatcacattgcatggattttgcaatgtaattttggataggcaaaatagataggcaaactagaataggaaaagtttggtttttattttatttttatttaacttttattttaagttcaagtatacatgtgcaggtttgttatatgggtaaacttgtgtcatgggggtttgttgtgcatattatttcatcacccaggtattaagcctagaacccactagttatttttcctgatcctctccctcctcccaccctccaccctaggaagagtttatgagtagctttgcaatcagccacaaaagggaggggctagaaacttctcttgctggcaaagttggcagagatacagcaattttgaggtggagtttgaggtcttcatattgaatttttaaaatgttattaataaatcactaaattcctatcttccacagtttttctgtcaaatagggctagataataatgtaacttcttaatcatttccagtgagaataataacaactttatgggcaagggtttcctcatcttttatttcctggagttaaggtttagtacatctcacgtggcagatatatatggaaacaggaaaattttaatgcaccagccttaatttgtagcccaagtgtccaatatacaacaaaggcttactaaacaaaggaaacatttatgtgtgtggttttcttactacttggtgagacccatcctacatgaacaattgctctttccttatctgtgtagcttttggtcgtattttctctcatcattgaaaatacaatatcaggccaggtgtggtggctcacacctgtaatctcaggactttgggaggcagaggcagaaggattgcttgaccccaggagttggagaccagcctgggcaacatagtgaaacccatcaagtagctgggtgtggtggcatgtgtctgtagtcccagctactcaggaggctgaggtgacagcatcacttgagcctgggatattgagtctgcagtaattgcgccactgcacttcagcctgagcaacagaggagacccagtctcaaagaaaaaacaaataaacaaacaaaaaacaaaaaagaaaagaaaatatcaaaagaaaatatcaaaacatagtttaaacagagggaaatggccagtgtttgttgctacccagtggaaagagaagttgagttaattagaaaatgttagtcatcttaattgagattgatttaagttgtgatgatccaaattcaattatcctgtgaagtgttttcatattaatggaagaaagctcactctggtgaactttgtgtgaatatagcttaatgtcagacttgcatttaaaaaatcaagtatataagtgttctttttgtgaaatagtaaattaatgtttttgtaaaagaattggtaaattcttgcctatgcatttgtgaaagtgagaattgtttatagtctaaggaaggttatgtcctgttttggaatgccttagttctgtcatcttgggtagagagttggtggttgcctcacccagaccactgggactggaggtctgggagtcatttgaaggtgaggctctcaccatgtggtctttgatactctcttctccagctctgggcagaggtgaccagcaacattctagcccccggaatacacgtggcaagccttaagctagggaagggaagggaaggaaaacggggacactgtagggtgaaagagagtagaagagaaaagagggagagaagactggagggaagggaagagagaaaagaaagcttctcgtgctgcaggaaaataaagcatggtagcaacggctgcaagaggcccactgacgacttctcctggctgcttccttccacctcagcatgcagcccctccagactgatgaccaggggtcatcttttgagatgttttacaaagcaattccgaaagctctgttagtcacttgtacaatttaacaaggatggacaccaggacactgtctttccactttaaactctttggctgtgccttggtttcagccatttcctctctttggaatgctctcgcccatgtcttcatataaagggagttgcaccctttaagctgcagcctgatgattacttcctagatgagattttcctggatccatttccccacactgggttaggtgtccttcctcggtgctcccattactgcccacagctgatgccaaagcctggcattctggattcaggctcgctggtgcccttggccgtgagcctttgtgcagggcacaacctgcacaaccgtacagagcagccttgttttttggcacatagtaggcacccagttaaatgtttgttgaatgaatgatctttagttttccagaaccatctcacaatttaactcctcttgagtggtggcattcagaactgaacaaaccagtctgtgaaggtcagggtcctattaggcagggtctgatcagtactggggccaccacaaggttctagaaccactcttgtttgttcctcgatggcaatacctaccactctaagaccaagaatgtgcatatgcccaaccttctcctgcatataactttgccttccccatcatctccatttgggcaatttgtttttcctcccagtgtgaagaaactcctctttccttctctctggccccatcccgatgtatcaagacctctttgtcctctggtcatttcttccatggtgtcggtgtcagtgtcattgccaggaacttcgagccagtctgtgcctgtcggtctaggtcactaatgaatcattaggttcctaatgaagtgctgagccctccaggatgctgtatgtcatggttctgttttggttggttttggtttttttggttggtccttccttggagggcagtgggacaactgcctggggctgctgttacctgtgctccttcccaagtgggttgcagattatccctaggatgtgtgggtgctgtggccaggtgcccaggatgggagttctgactcttggacgcagcctccctgtgagcggccctgaactggagcagggctcttaagtacacccggaggtcatttccttcccacccaaaccacttgtaaagtctgcctgccttttttaaaatttatttttttgggtcacgctggtattaccctgggttttagccagcttgataaatagaggaagttgggtggcttcccagcctccctgatgtcatggtttggggcaatctgcaactgtgggaggtttcatgaatcctagcaagtggtgagtttgctgttcttctctgcgaaatttctctgttccgtgccatgtcttacataagttgatatggttccttttgtgacttgccctttcccttcaatgatgtaagaaccccaaacattggtagtcactatgttttgtcactgaagcgctggtgctcatcagatcctcattcctgttccgcttctctaggagataaaggctggtgggtgtgtggtggccacaggggcaaggagggatctgtggactgaaggatgggcctttctttaatgaagttgaggccttggtattcatcaggcatttttgcatcattgcttttgccattattttccacaacttgctgaagtgagttcctgctccctggctgggaagctggtttcttggccctgaaaccagaagtctttgtgttcccagttgggcctttctaactgaggtagagcaggcgaaggggagatgacgttgagctgagcaagtgatggctttccgtcccattccccacccactgagcttgatggaggagctctgttcagccctccttctgcttttcttcactagaagaaatctacttaattgtgtaagtactatgtaaagacatgcctgtggtctatggagtagcaatttggcttcatcctttccctcatcacactcctgggttactggtgggtttccttccaggctattttgtatgcatccacccttgtcactgtattaataaggataggccatgtgcagtggctcacatatgtaatctcagcactttgggtggtcaaggcgggaggattgcttgagtccaggagtttgagaccagcctgggcaacatggtgagaccccatctctacaaaaaactaacaaattagccgagcatggttgcacgtgactgtagtcttagctacccaggagactgaggtgggaggatcacttgaacccaggagtgggaggctgcagtgagctgtgatcgagccactgcacttcagcctgggcgacaaggcaagaccccatttctaattaaaaaataagcatacacatataactttgattgcatcttaacaagtcctcgtatatatattattcagaaacttggttttttctcttgccttatatgcattgacagtctctgtatgttaatacacctaaatgaacttcacttttaagtgttgcataatattccaaaacacagatgtgccattgtttaactcttcatctactaatggaaacttaggctccccccaccacacacacagctgcaatgacagtatttgtgtgtatatttttgtatctatgggtcagtatttctgtggggacaatctctggaattcaaatttctgtatcaaaaagcatgcacatttaaaattttaaaacatagctaaattactctctcaaagtttatgtttccaccaatggtgtatgcaggtgtttatttccccacatgctctccagctttggatattactaggcttttcaattttttcatccactgggaaaaacaaatgtcatgttgcttgccctacttttctacctgtaagtattccaagggagcgaacagagcctcctgttgttcattaataaactggattcccaagaaccattaagtgtgctttattatggtcatcagtaaggttttggaagaggtagtgtgcttgggttgggaaatttcatcaaaatatcagaaatccctatgtggaaaattctcattttcacaaatgttaaatgaacttctttcgatactcaagtcacaatagatttctttctttctttgattattgaaatgtttttcagttgttaatcctacatttagtccacattcagcattgggacatgtgttcgcaattgttcatcgtaggacaggacaacatggttggccttcatttttgtcttttatttcaagttctggggtacatgtgcaggatgtgcaggtttgttacacaggtaaatgtgtgccatggtgatttgctatacctatcaacccatcacctaggtattaagcccagcatgcattagctattcttcctgattctctacccaccccctccccgacaggccccagtgtatgttgttcccctccatgtgtctgtgtgttcacatggacacacttataagtgtgtcaccttccacttataagtgagaatatgtggtgtttggttttctgttcctgcattagtttgctgaagataatggcttccagctccatccatgtccctgcaaaggacatgatctcattcctttttatggctgcatagtcttccatggtgtatatgtgccacattttctttatccagtctatcattgatgggcatttaggttgattccatgtctttgctattgtgaatagtgctgcaatgaacatatgtgtgcatgtatctttataataaaatgatttctattcctttgggtatatacccagtaatgggattgctgggcactgaactgctattataacagtctgtcagtaggtcagttggttccaggatgaccttagagatcgtttcttatcacagatcttcatttgaaagtcattatgtcctatttcacatgagaagatgccattacgtgaagtgactgtcatcttcaagctaatagctggaccaatgttttggttcagaagtaaggcatgttggaatattctaaaagatacaagtcaggtcgtcagcaatgctctctgccttgggtggataccccattctttccccagcgtgcatctgagttttccctcatatcattgcaaatacccccatgttcccctttcaactctgagccaaacttagtaattaaccaagagttagccctttagtggagaaacaattctgcctctggcacaagagacctaaatgccccaatccttgatatcaaggagtttaggttctagggaagtgaagtcacaaacacatgaagaaatgtctaaccaagcagggtctctagaagggaccaccccaccccaggtctggtccaatcacttcgttgtccagtgccctatgatgttgttaatgaagtcttcaactgaacagtaattcatgccacaaaaacattaacaaggctgggtgtggtggctcacacctataatcccagcactttgggaggctgaggtgggcagatcacctgaagtcaggagtttgagaccagcctggccaacatggtgaaaccctgtctctactgaaaatacaaaaaaaaaaaaaaaaaaaaattagccgggtgtggtagcgtgtgcctgtaataccagctgctcaggaggctgaggccagagaattgcttgaacctgggaggtagaggctgcagtgagccgagatcatgccactgcactccagcctgggtgacagagtgagactccgtctcaaaacaaaacaaaacaaaacaaaacacattaacaagatcagtccccaaactggctttgggcttgtgcttccagtttatatataagttcctcagcagcagggtttacatccattttttctgtaactccactgccaagttcaagctgtgacgtgcagtagggagcccagggggcgtcggctgatgagctcactgcagtattgaagtattatgctgtcaagaaagtccactttccattggtctaattttgctttttattttttatttttcattttcaggtgtgcacagaggttctccactttgttttctgaactcgcggtcaggtgagtaatgctatttctatgagataatgttgtagaaatgaggaacatgttagcttgggtttttttttctttcctattttccctccttcattgcaaattcccatccccataccaactttattcttttttgtttgttttgttttgtttttaactcctcactcccacttggagctctcttttcttcagatactttcttttccttggggattctattgttgacctgtttcttcttgctaacccaattgcttttgaatgggcgttcagaaatgggtaccgattttgaagttacatggtgcggtcaaagctggggaaagagaatgatcatttacgtggaattatttgggattctgtttcactgttttcccctttcctgctccctggacgtgtgtcccttggctctaacagcttttgtcatgttttgtaatggaccaaggaagtgtttgttctctctctgacctaagtgctgtgcaaatgcagctgtcaaaggatccttccaaccagatttctgcccatgaccctcttctagatagaaattctgaagccgctactttcacgcttcctatttctttcttttttcttttcttttctttctttctttcttttctttttttttttttttttttttttttgagacagggtctccctctgtcacccaggtaggagcgcagtggcgcagtcacagctcactgcagttttgacctcccaggctcaagtgatcctcccacctcagcctcctgagtaactgggaccacaggtgcatgcaaccatgcctggctaattttttattttttgtagagacgggatctccctatgctgccagacgggtctcaaactcctggcctcaatccatcctcctgcttcagcctcccaaagtgctgggattacaggcctgagccactgtacccagcctatttcttttgagactcataaatagtggtatttctgggaattcattgacataaattatcaaaattttgtaaacaatgtaaatgtctatcataatgaatacaaattagaatgatcccattataacttacatgataaataacacattgttattataatagatactagtaagttattgctataaataaggttataacagctgagcagggtcacacagccagtaaatggcccagctgggacctgaagcaggaattggcatggtgtgatgacaaaaccaaggaagggcacagaatcctggcgaggggtgggccctggtgggtgaggcggggttggtttcctgagtccctcacttcctctccagcatggtttcctagatgaccgccaaccatgtgcttttgccctatccctgccccagccctgcagtgcagatcaatgccccaggaggcttttaagaagagcctcttatttctctcctctacatattgatagaattattttgcagcagtagattctggaccaaatcaatgaaaaaatctttgtcgagtgcctgctgtgggtgtgggggtgaggtggagatcaagcctatataggagaggctattgtgttctgcttccttgtttttgtttttaggcaaagtcgagtctgatggaccatgaagagaaagtatcttttgtttgttgttttaaaaaaaatcactattgatttggccatgccaatgaccaatgaatctgagtagtggctattaagctatcgagggcaggaaagatatctgccttgttttttgtggtatctcaagtccctggcatagaatcttgcttgtaatagaacttcaataaacattcgtcaactagatgaatgaatgtcaattattttggaaataattccaaaatctgtttacagtttgtactggagtgtattataaacttatcttctttagctgagtatggtggcgtgtgcctatagtcccagctactcaggagcctgaggcaggaggatcgcttgagcctgggaggtggaggttgcagcaagccgagattgtaccactgcactccagcctgggtgacagagcaagaccctgtcacaaaaaaacaagcaaacaacagcaacaaccaaaaaacaataaaagaaacccaaaaacttgtcttctaattatgcttgtaatcatagctaacacttcttgactacactaagactttcattacattacctcatttaatccccacagaaccctgtgaaataggtcttagcattacttccacgtcttcagatgaagaatttaaactccagagaggttaaggaacagcccaagtttacactataagtggtggagcttagatgtgaaggcagacagatggctctaccatgcatgctcccgaatcctatgctattctgctcattattgtgtgttaaacatactgcaagcattgggggcagaccctgaagaatgaggggagagagatgaagtaggctttcaccttgcgttggataattcacacatggctaatcaagagtatggtagatcgcaggtatgagagagtggagaaatctggagatgagcaagggagccaaaaaacagaacacccctcagccgggcgcggtggctcacgtctagaatcccagcactttgggaggccgaggcgggtgggtcatctgaggtcaggagttcgagaccagcctggccaactgggtgaaaccctgtctctactaaaaatacaaaaattagccaggtgtggtggcaggcgcctgtaatcccagctactcaggaggctgaggcagaagaattgcttgaaccgggaggtggaggttgcggtgagccgagatcacgccattgcattccagcctgggtgacaagagcaaaactccgtctcaaaaaaaaaaaaacaaaaaccaaaccagacaaaaagcagaacacccctcaccaggtttggtgagtgtatgtttacattaagcgcacaatttagttctaatcttgcacgtctgatattgattcacttgttttattgaataaagcttcctttttctgcatcagaaagcacttaccgcttattaagaaaatcatttttgcactgtaaagaccaaatcatttccttccatttgattctagagatgtgtaagtttcacactgcaatgatgccatatggctcagcattggctttactttgtgctctgacaaacaacatacaaggctgctgttttagagttcctattcagcacttaccagttaacctagtttctgtcatctttaggacatggttgtttttggcatatgggatgttgtttctcttactacggtaatactggctttagttcttggtgaccttatcttcaaaaaattttgttgctgaagttcagaatagttccttttgtccaatatttattcaaactacctcaatttacaagatttgaaattgcttctagacatttctgtgagcattttggagaaatctgaaaacagtctcatttgatttatataatgggcaaaaatctaaggactttccttgtctggttttggcatcggggttatgatagccttgtaaaagtgagttcagatgtgctctttttcttgagtttctgtgcgattgaaactcttattccttaaatatttgatagaatcatcagtgaagccatctgggcctggagttttctttgtgggacaagttttgagacttttaatggttatacctactattcatgtttaccatttccacttgattccttcttggtaattggtatttttttctagaaatttgtccctttctatctagagtttcaaaattattgaagacagtttttgctaagagccttttatatttattatgtttatagcatttacaggtgtgttgctttttccgtacctcttattagctacttcctcactccctgcctctctctttttctcccctttttccctcccctccctctgtctcttgattttgccagaattgtcttttcaaagagcaacgttggctttgttaatctttatgtcttttttctgtttttattatatgcttttttttttattaccttccttcttcttctttgggtttattttgctgtactttttcacacttcttaagaaccttaattcattaattttaagcctttctctttttctaatttgtatgtttaaaatataattttcactctatctttagctgtatcctatgtgttttatatacagtgtttttcttattgatcaagtcgaatattttcttttttcttttatcttttttgtttttgagacaaggtcttgctctgttgcccaggctgcagtgcattggcgtgatcatggttcactacagcctctacctccttgcctcaagcgatcctcttgcctcagactcccatgcagctgggaccataggcgcataccaccatgcccggctaatttttttatttttttgtagagatggagggggggtcccactttgttgcccaggctgggctcgaactcctgggctcaggtaacccttctgccttggcctcccaaagtgctgggattacaggtgtgagccaccacgcctggcgaatattttctaataaacattgtgacttctttgacccatgggttatttgttaaataacacatctaactttttgttattacaccttaattgtgttgtggtcaaagaacatgctgcttttctgttttccaattgtttaaaaagcttttgagacttttctgttggtctggatggttttcacagacattccatgtgctcttgaaaagattatgcgcgctgcagttgttgaatgggggcttctagatatggtcctcatgttgttggttaaatgtgtgattcaaatattctatatccttaatgactttcttatttaatttttaccaattgctgatagagatctctcattatgattgtggatttgttctatttctccttatattctgtcaatgctgtttggtgtattttgaggctatagtagttgcattcacatgtaaatttcttcagtcttcaattcagaattgaatcttttatgaatgaacggttttatttctaggtaaagtattttgctttaaagtataatttgtctgatattagtataaacacattaattttcttttgattagtgtgggcatagcatatcttttccatctctttactttcaaactttctgaatcattaggttctatttgtgtccttgtaaatagcatataattggagtttgtatttttttcagtctgataatctttgccttttaatggaatcattgagtccatttatatttcatgaatcattgatctgcttttttttttttttttttgaaatagagtttcactcttgttgcccaggctggagtgtagtggcgcaatctcggctcactgcaacctctgcctcctgggttctagcgattctcctgcctcagcctcccaagtagcctgggattacaggcacctgacaccatacctggctaatttttttttttttttttttttttttttttagtagagacagagtttcatcatgttgatcaggctggtctcaaattcctgacctcaggtgatccacccgcttcggcctcccgaagtgttgggattacaggcgtgagccactgcaccggcctgcatttgtttttaaatctttattactttctatttttcctaaccattctttgttgctgtttctcctctttcttgccttttttcagactgactgaatatgttagaaactgttttcctcctccactagttaggaagttatatgtcccatttctgttgtttagttactaaagatattacaacctgttgtagaaattacaacatgtctactcaacttttcaatgtgtaaagataatcaatacctttagcttcctctagtataatccaaggaccttgaaagactttaatttttgaatttcattttgtcatctccttacttatattacatataatgcatatattgtctcctatgtttatatatatgaggtagttgccatatgtttttattttatcatgtttcactaatccctacaagatgttattgttttatatagtagttttgttttgtttcaagacacagtctccttctatcacccaggctggagtccagtggcacgatcttggctcactgcaacctccacctcccgggttcaagcaattctcctgcctcagcctcccaagaagctagggttacaggtgccagccaccacatctggctaatttttgtatttttagtaaagatggggtttcaccatgttggccaggctggtcttgaactcctgacctcaagtgatctgcccatctcggcctcccaaagtgctgggattacaggcgtgagccaccatgactggcactgttttatatagtaaaagttcatttggatttgccagtagagagtactacccctagttctgggcacctggggcctctggcctgtgacttgtgatttagagtcccctctctggcccttctctagctccacccttctccaaatggcaagaagtctgtggcaccaagaagtcatgcctacccggagctacctccctcttcccctcacccttgcttctagatcgtactctgggaatccgggaccctggaattcccaatccaaacattctgtgccaatttccaggacctgggcactccccttcctcattgcaagccatgctgcaggtgtacgtacccccagacccaagggatgaccaaggggtacatgcatgcaggagagggggttaggggtatgcaggctgtggtgatcacatgagtgtgcacaaagcctcttacagcttggaatgaagccttaggggaagaataagggcaaagccttcttttaaactcttgatctgtatcttagaaatgttagccatgggcctggccacaaacccaccactttctttgttcctcattcctcctttcatctcagttcttatgtcttttgcctaaatacatgttttaggattgatttcagtaatgatttgcaggtagggaacaacatcacagtttctgtttgtctgaaaatatcttcatcttgccctcattcttcaaagatattttccctgagagcagaattctaagttggcagtttgtttctggcacactgcagatagacttccactggttctggcttccattgttgcttctgagaagatagctgtcagtctaacagcagcttcttaacagcctttttctttctttctttcttttttttttttttttttttttgaggcgaagtcttgctctgttgcccaggctggagtgcagtagtgtgatctcagctcactgcaacctctgcctcccaggttcaagcgattctcctgcctcagcctccagagttgctgggattacaggtgggcgccaccacacctggctaatctatatatttttggtagagacgggggttccgcctcgttaggcaggctgacctcgaactcctggcctcaagtgatccatccgcctcggcctcccaaagtgctgggattacaggcatgagccactgcatgcccagcctaacagctgctcctttgaaggttatctgtcttgtatttctgacaatttttcagatgttcctgtttttgtttttgtttttttttttcattttcactatgatgtatctaggtgtagatctctttttatttcttttgattgagattctttgggctccttaaatctgaggattggtgtttttcacccatttggagacacttagtcattatcattccaaacactgattctctctttgaattttgtttaaatgtatgttagacattgtatttcttttctccatgtctctgaacttttctttcatatgtcatatttgaaactcaggtttgcctcattaggcccatacccacaggtataagtgggcttcattgcttacattacttacctgggttcctgcttgagtttcacctttggcctggcaattcctttctatctggccagctctttgatatgtttaagaaaatgcgcagctgggcatggtggctcacgcctataatcccagcactttgggaggccgagccgggtggatcaactgaggtcaggagttcgagactagcctggccaacatggtgaaaccccatctctactaaaaatagaaaaaattagccgggtgtggtggcaggcgcctgtaatcctagctactcaggaggctgagacaggagaatcgcttgaacctgggaggcggaggttgcagtgagccgagatcatgccactgctctccagcttgggagacagagcgagactccgcctcaaacaaacaaaaaaaaaaaaaaaaagaagaagaagaagaagaaagaaaatgcgctgggtgcggtggctcactcctgtaatcccagcactttgggaggctgaggcccaggagtttgagaccaggagttcaataccagcctaggcaacatggtaaaacttcatctctacaaaaaataaaaaaattagccaggcatggtggtacatgcctgtagtctcagctactcaggaggctgaggcaggaggatcaattgagcccacgaggttgaggctgcagtgaaccgtggtcatgccactgcactccagcctgggtgacagaatgagaccctgtctcaaaaaataaataattaataataataagaaaatgcttttagcattttattcatgatttttaattgtcttcagcccaaggtttgatctaactaacctaacccaacatattcccggaacactgaagacattttttttttccctgagatatttcctgtatcgaagtcattgagcagtgttcaaatagaaatttaattatgcttttcttaccagtttcctgattctttttctgacttctttgagaattgaacaatccaaatcaactgctttttcactttttgttctcactttatccacactgagaacccctgcagtccttctctttttacatttccccttgtggtggtcttgtaagccaacatatatgactccgtataaatgtctcaaaagcatagagttttctagaagacttagggaacaattatcatacctcttataactcaggtcagaaatattgatcattgtctatatcatagtggctatggtataatcaaagtatgccagttaaccagagataacagagaataaccctcacacagacctgccctatggtggtatcaagctatttctccctttctaatattattctttgattattctatatctaaagacagatttatcatttattggcataacaggttgcactgatgatatatatttcaaaaatatgatactgatactatttaatgaaattgaagagctctagaacgagtttttagagtggaagcaccacggcatatagtcatgtagttcgtgcactgtacaactctagagggaggttgccatttacatcagagttcacaacctaaaagggggccctggataaagatgaattggggatcatctttaatctagtgtcaaggtctacgtttcactgtttaaatgctaccaaatagttttctctgtaattgttgctatcttcctagccatccttagcaccttaaaaatttactaagaaccagtggctgttcagatcctctttgttgatgacctggatagcattgagctaacccagattgcaccagaagatgaatagatgtttgtgttaggctgttcttgcattgctgtaaagaaatccctgagactgggtcatttataagaaaaggggtttaattagctcctggttctgcacgctgtgcaagaagcatagtggcatttgcttctggggctcacttatcaccaaggggatggcccaagctattcatgaaggatcctccatgatccaacacctcccaccagctcacacctccaacattcaacatgagatttggatggggacacgtatccaaactatatcaatgttccagctgaaaaagagaaaaatggctttgatgtgcaatgactaaaggtttcaaacttcacagattgccctttgattagtgatcctagagactttatgacctaataggacattctcggtttatgcagaaggcagtaggagctacattatttcaaataccataaaacttctccaaaaacatatgttcagccttgaggaaacgtattccagatctgacaactgaaagcagtctgcattaagttcttgatctatatatttttttcaagatgattgctggggtcatctttcattctggcctttcctacctgcatttggaagttgagtagatcctgcctgtagtgaaaaggcatagtttattttgatcagaggtctcagttacagcacatagtagtcactcactgtgtatgtacactgagtcactgagtacacgaatttgcctttgatcatatcttgtacaccacttaggtcctgccctacgagttagcaaagctcaagaatgagtctttagacattcttaaattgtataataacattttgaacttgatgtctttcacctgatggactcaaaacattttacttacaaggagacaaagtctcaggaggctggcattgtgttctggtagaaagagtaagggttctgccaaatagctgaatgaccttgacccatcccctagacttgcaggggtgtccaatcttttggcttctctgggccacattggtagaagaattgtcatgggccgcacataaaatacactaacactattgatagctgatgagttaaaaaaaaaaaattgcaaaaaaactcataatgttttaaggaagtttacgaatttgtattgggccacattcaaaaccatcctgggccacatgtgacccgggggccagggttggacaagcttgcaatgatgggacctctttcatctgtagaacgagggttcgaggataggtgatttctgagttcctttccagaaataaaccactctgatactctctccccaggctacacttaaatacttgtgaattaaatctaagtcaactccaccagtttcaggtacagtcaagcctatttgtagaggagagcattttctgtggcactgaagttcactcaataatgccttcattttttttttttaaagcagtgcttttggaggggggacagagttcaaaaactttaaaaaatgttaatttttaaactttttattgaaacttatggcatacatatatgtgtacaactcagtgaatttcgtgaactgaacacacccatgtaattggcacacagaatattctcggtacctcagaagcctcccttgtgcccacatccaatattgttataactccctccctttcaaggataacccttctcctgacttctcaccacatcaattagttttttctgcttcggtttctcatgaatggaattatgtacaataagcactcttttgtctctggtttccttggcaaacattatatttctgagctgcactgagattgttttgtgtagctgtagcagacacttagatctttcctccagagagacatcgatacatctttgcacaactgtgttaacatcctcatttgagtgactcctttgggaagatcaataacatgccattatgcccagagagaggttaaaagaggagggagaaattagaggctttttataattgattaacatattctagcattaatacataatacaatttattaatttaagatatgcaagccctcttctgaaggagaaagattcacctcctggtctaaaacatcatcatgtcaggtcaaggaaagaatcactctcctagtgctggttatgagtattcaattacagaattcttaaagattgccagctttaccttgagacagaaactctgacttataaaacccctttctttccatgccctccaccccttaatcccagcactgcctgatcctgcacatactaggtgcaaaatagatatttgttgaatgaatgaatgaatgaatgaatgaatgaagagcacagctaacatttacagtgcattcacagtgccagccactgtgcaaagatttcttgtttactcaccgcaacagcactatcaggtgggtgctgttgtctcagtttgctagatggggaaacatgaccattggaaataacttgtccacagtcactcagatattatggggccaagttgggacctttgaactcatgctctttagtcttcaccactgtgtattcacactcactctagggcttgcagaagctgcaagtggtggctggattcatgagtgcccttggccgagagctctgctagctgaggacacacagcctggtttgtcccagccacttccctctggctgtgtagagggagcctgcccagttggctctcgccacccccttgcttgtgcctgtgcccatgagtgattcctttctcagcaccccacgccagcctctgctcctagtgctgactgcccatcttggggtaatgttggccaactcccagacatgagaggatcagacacagtcttagcatttgcaattctttctgtgtgctgaactctcccctagcccctgccccacctccagcacgtgcatttcatctagttcactcctattcagccctcacatctcatctggtacatattggccctcaataaatatttgttgaatgaataaatgaatgaatggtaaatgaggcttttaaattcaattctgatataaactactgaaatgcaagcaatgatgataaaataatatgcaacaaaaaggaaatgcaatgtactgatgaaactggatagttcccttgacccctctgtgggattcatgaaggagtggctcgcttactcagcccacagctctcaacccctcgtgggagggggagcacgcaggtgagtgggtacagaggccaggttgagtgcttctgggcaaccagcaggagcaggactctgtgcaggcccacagcagcgtctacaggttgcccgcgacccccgagccccagagggcatgtgttaccgcgcattcttttagcattgccatccttggacagtgtaagtgttaaacagttcagtggagggtcagtgtgacagcctcttgcacctgcaccaaggtctttgtctggcatccaggagtaatgaagttgtaagaacaaattggagggtggtgaatgcagaggattttattgctgatgaaagtggctctcagtgggatgggtggctggaaaggggatggagtgggaaggtggtcttcccctggagttcggccatctgcggctgaactcctccgaagtcgcactgtcaagccatccctctgaagtcaagctgctcctctccaaggtccggctacttctcttctctcctctgccactctgccagtggggcctgggatttttatgggtacaggatttgggggcagggcaggccagggtggttttggaaaaggcaacattcgggcagggaaatgagaatgcatgttctcacttttggctgcgggtccaggcttgagggtgtggcccttgtctagggccacactcttctacccaatatttccctgcctcctgtccatatcacttatccttttacagtataaaacatacaagagcgaaactccgtctcaaaaaaaacaaaaaacaaacaaaaaaaacatgaataggagctgggcacagtggtgctgcctgaggcaggaggattgcttgaagccacagtatactatgatcgcacctgtgaacagccattgcactccagcctgggctacatagcgagaccctatctctttaaaaaaaaatttttttaaggaaaaatgacatagagaaggataattattgaaaagattctgtgtaatggtaataatgatgtaacattttgtgttttttattccttctcttgttattttgcatgtgttgatgttttccataaatccacatggactaccttgcttctaagtataacatcctactgggcaaccctcccataataaacatgggttttgcttgttgtcaccagtgcccaactggcgtttctgattctctggaaccatagcaatttgaagtgcacaggatcacaggttgccttggttgaggaatgacctttgaggtattgctgtgttgtgattatggcagctgtgatgatctgtcttctccttactttattccaggatggttttctctgtcaggcagtgtggccatgttggcagaactgaagaagttttactgacgttcaagatattccttgtcatcatttgtcttcatgtcgttctggtaacatccctggaaggtaatgtgtctgtttttcttcattttttttttttctgtttatctgcatgtgtgtatttttttgttatttaggatttttttactgtggtaaaataacataatatttatcattttaaccatttttaagtgtacagttcattggcattaagtacattcacaattttgtgtaactgtcactgctatccatttctaaaacgttttcatcatcccaaatagaaactctatatccattaaacaataactcccaatttccttcccccccaccccttcctggtaacctctgttcctgttctttctatgtatttgcttattgcaagtaccttagataagtggaatcatacaatatttgtccttttgtgcctggcttatttcacttaggatgttttcaaggttcacccatgttgcagcatgtatcagaatttcattctttttaacagctaatgtttcactgtatgcattgacccattttgtctattcattcatccattgatgggcatttgggtcgtctcccccttttggctgttgtgaataatgctgctatgaacatgggtgtacaaatcactatttgagtccctgctttcatttctttggggtatatacctaggagggaattgctggatcatataaccctgtgttgaacatcttgagaaactgctaaactgttttccacagtggctatatccttttacatttctacaagcaaggcacaagaattccagtgtctcccattcttgacaatgcttgtattttcctgttgttttggtaatgggtgtgaagtggtatcttattgtggctttgatttgcattttcttaatgattagtgatattgagcatcttttcatgtgcttattggccacttgtatatcttctttggagaagtgtctattcaagtcctttgctcagttttgaattgggttgtttttgttggtgttgagttttgaagttctttgtgtattctggatattaatcccttatcagatatataacttacaaatattttctcccattctgtggggtgtttcttccactttcttaatagtatcatttcatgcataaattcttttaattttatgtagtctatttatttttacttttgttgtctatgctttggtgttatatcaaagaaatcattgccaaatccaatatcatgaagactttcccctatgttttcttccaagaattttatagttttagctcttatgtttaggtcctttgatcgatttatcatttttgtatatggtataaggtaacggtccaacttcactctcgtgcatgtgggtattgttttccagccacatttcttgaaaagactgcctttttgctattgaatggtcttggcaactttgtcaaaaatcactttgttataccagtggagggtgtctaggtttttggcatcttgaacaaataattggacaaaacgcactaacaaagcaaggaaggaatgaagagatttattgaaaatgaaagtacactccacagtgtgggagtggcccgagcacaggggctcaaagtccctgttacagaatttgtgggagtttccattggttacttggtgtatgccctatgtaaatgaagaggatgaagtaaagttacaaagtcatttactcagcatacaccctatggtgaggatatttcctgtcatagctgaagtgtgaatcggccttatgttccctgcctccagaccctattttcctgcctcaaagtgaccgtatagatgagggtttatttctggtgtttacttgtttttaaatgtatctacttgaaggtacaaccatatggaaatttaaaggtggtagagaatcagacagatgaagcagcctggtattttcggaaagggggatctttagaagttcatggaacaagaagaaaaggcatctgagaaaagcagttgaaagaccagcaatgctgggcctgcaatttctgtgggcacaactgccaaaggcaagtgtaaagaatcctcattaggaggttcacacctgtaatcccagcactttgggaggctgaggagggaggatcatttgaacccaggaattcaagacaagcctgagcaacatagtgagaccccgtctctacaaaaatgaaataacatgaaaaattagccgggcatggttgcgggtgtctgtattcctagctactcaggaggctgagatgggaggattgcttgagcccaggaggcggaggttgcagtaaacagtgaccataccagtgcagtccagcttgggtggcagagtacaaccctgcctcaaaaaaaaaaaaaaaaaaaaaaaaaaaagaagcatcctcattaggaatgggactaggaaatgattgatacttaagacatcaaggacacacaacgaaataactttcttattcagaagtgggtggcaggaccaaggaatctttattgcataagataaaaatctactagcagcaaacaacaaaacatacaaacaaataaaacacacatacaaatacacagactaaatggaaaacttcccaacaagctataacacaattggcaatcctttaaaaagtaggtactggggcacgttgtcaaaaagccgccattctttaaagaaagaaataatggccgggtgcagtggctcatgcctgtaatcccagcactttgggaggccgaggcgggtggatcacctgaggtcaggagtttgagaccagcctggccaacatggcaaagtcctgtctctactaaaaatgcaaaaaattagccgggcgtggtggtgcacgcctataatcccagctacttgggaggctgaggcaggagaattgtttgaacccgggagcagaggttgcaatgagctgagatcatgccattgcactccagcctgggtgacagagcgagactctcaaacaaaaaataaaataaaatctaaactattctcacacgcaccatctccttagggcactgaaacattactgtgggcttggcagggcaaaactcaagagtccccactttactgatgagtaaatgtccccagggaggttattggttaggaagtggcggagtccagattagatgctagatcttcagtctcacgtttcggtgctttttccaccacaggggtagatgaggcaggaaagtggaacacaagggaaaaaattcatccaaatgaaagctgtttgttagaaatatgtctttttgaaaaattatgttttaaaatgccaacaacaggggcaggtaaataggaaagtgcatggctctgaaacaaacctaagtagggaaaagctgagtgatcactcaaggcagctgactgcatttcttgctccagatctctgatgaattgatttcttaaagcagtggttcccaaagtgtgacagacaagtagcactggcatcacctgtctctcagaacgcccagtaagagtatttattcatgttatttatttattttgtttttgtttttgtttttttctttttctttcttttctttacttttttttttttttttttttttttgagacaggatcttgttgtcgcccagacttgagtgcgcgatctcagctcactgcagtctcaacctcccgggctcaggtgttccttccacctcagtctctggagtagctgggactgcaggtgacatcaccacgcccaactaattttttaaattttttgtagagatggggtctcgctatattgcccagggtggtctcgaattcctgggctcaagtgatgctcccaccttgcttcccaaagttctgggattacagatgtgagccaccacgccctgctcatgttactgaataatcaccttgatagcactcaccatgtgccagccactgttctaagcccttacaaatggctaattcatttaaagcccactctataaccccttgaaaaaggcactattatcagcttattttacaggtgaggaaattgaggcacagaggagttaagcaacttgccttcggtcaaataattaagaggttgcagagttacaattcaaattcaggccatctggctccaaagcttgtatgttggacctctatactatggtgccttttcacattcttaacctctctgctatgctaggctcagttgcttggtagttgtgaatctgtagattaaaaataaagatggaatccataattgtgagaatcaatgttgttctggatcacccaggtggttcataggcaccgcctcctccaatagctttggactggggcaggggttcttttagttcaggatggctcaggcctggtttttgaaggccaaggggactgacctgccacttctccactgggttatcaattgtgcgataatgattgcctgctgtgtgcccagcagtactggctgctgagaacatcgtctctgactccagggaattcacactgcagttggagggccgtgactatgacgcatgagaacaatacaaactataagtcttaaagtatgagtcagcgctatagggcactcacatatggcctgtggccagatctgtggattagtctaattcgatgctaagccacctatagcagatgctattggtgccctgcctatacccccttggcccaccccaggggtcacctgcagacagttcctgtggatgcttacggctttcatgtctccctgaggatcatctatgtccatgggagtgtgcttggcccatgtgcgggacaaaccagaagtgccagggagataacacccccaaacagtgagtaatgggagttggtatttaaatatgccagcttccttgtcccttggtgggaccacactcagatgtgttctatgttatctcccagagttccccagttgcattgtaccccataatactcatctgctcatgaatgtgcccatttccggattcacccccttgtctgtctcacttgcatattcccccactctgcttctggggaccctccctattgggaaactccccttccaaagttgaggccaaatcttactacctctagaaaacctgccctgacctcggaagaattaaatccccctccccagtgcttgcttctctttatccatccatacctggggatatcactttgtgtcacactcattacgggcttcctttgtactgtgagtccttgcagtgtgcggtcagtgccagacaaaaggttggcgaggcgggtggcgaactcacgggagggaagctgatgggcactgagagcctgctcagggccactcttccaggtgctttacgcacattatctcatttaatccttacaaaacctctttccggtgggtagttttcatctcggtttacagacaaagaaactgtcaaacaaatgaaggcatttgcctagaggtcccacagctaggaagattccccatcagaatctgtagcctgtactactcacacgacaccaggctgcccagggcaccctcagtaagtgtctggggactgaatgagcatgtcactgaggtgcagggctaggggagtggagagggagcctggggtgagctgttagagagcagcagctcccccgacccggggctctgggagatctggaccgtaaacacagtagcttcaccctggaagcctgagaggtgactcagtagctcttgacggcagggagaggtgggatgacactctctcgtcaggccactagccaacagagagagcccgtggaccttaacactttcagttgtgtgatttggtgacatttgaggggctcattcttggtctaccagaatgggttttggcacctccagcctccagctctcctgggcggtaccaatgcctttttttttttttttaaatctttgaaggaggtcttcttttagatacaactattctattttccagaggggcagatgacataatagtggaagatggttataatttcattcttgcagagttgtcttcctcatttggaaacaattacacatttgagccagtttggtgatctcatgagctacaatccccaactttctctctgggctgggtctagatctttctgtgctgcaggcatttccagcgatgagtccctctataattcccctctctgaggcctggctgtctgatttcctcctatcctctcttgctgtgttcacctgagtccttggtcttccttgcgaggaagtcggtagagctgcaggaaatgggctgcgtgctcctgagaggcgggaaacctgttctgtttcattttgtcctctaataccagaccctgtcctggtctcctcattctctctcaatcccctgtctgtacaaatgaggttataaatgcttaccatggcactgatctgatgctcagccaatctcacaacccccactgacccctgccaaatcttactacctgcacccaggcatgaggccatgtctgttggaccctggctctttccctagcaggtggaagtggtgatggggagtgatggagagtctatcatagataggttgcaggggaaactgaaagcagagggcattgtgtcccactctccacttggaactccaggtaaggactccttatgggccctgtgtgtcagcacagggcagttgcagagatgaagtggcaaaactgtttcctctgggagatgatgtcccctccaagtctctctcagctctcatgtggtagagtagggactctaaagtaccctcatgttcttagtgggtagctgtgatgagatccaggggtggggacagggctgcaaagactatggcatggacagcctaggccaggggtcagatggaggatgagacagacattcagtggtgagagctcaagggagctgtattagcaggagaaggaccccccaggcctggatgggattctgaagaatagaccatgggcccactggacacagccttcagcagtggacaccagttggatacccaggagccctgcaggatgagggaggtctctggagaggccattgagaactcagggctcagcactgggtgagctcacagatccaggccccttctccctgctgccagaaaggccctagcacgccattctcagcccaggcgccatcttgactaccagaaagaaaaggagggtggacaaagattgtgcatttattcacaagtcattgggttaactagagaccattttagagcaaaagagacaaagctaccttaaatcatcagacttaaggatctctttcctatatttctggagtggaggctctgaaacaaaagggagccaccctagatatcaaaggcagctcaggaatttttggtgtgttttggtgctattgtttctacatctaaattgtatctataaattttaaacttgctttaaaatgaatacatattgaacacagaatgatgtgtcagggcactccattaggaattgtgggaggccatcatcatatcttgaactctgatcctcctccaggttttatcttttcaggtatgtagagacatcattcaggtcctagagggtaatggtgacatcttttctctctttgtagcctccatattttctagcacatagtaagtactcagtaaactgtggttgtctaattggtttcgatttgtgaccctagtctaaagcctagagatattccaaaaagtgggccccccctcagcttacatcagcagtactatgctcatccgaacccagtcagttctgatacagtgtagactactccaaacttctgtatagacttcagtgaggtggctgtaccttggctaggattacccttgaagaatggatttcccctcctccatatgaggaaggagctcaactgattccccgttaagattccttcacagtctgacattctgtgagttcaatcagccagtagggaccatcttcagattcttcattcattgtcctggaataccagggatcctcgaacattatgtcattctggaagtccttgggtgatgtctgagctgctgattatttatgccaggttctcacatttgggtgcacattggaatcacctgggggaatttaagaacacctgcctcggccgggtgtggtggcttacacctgtaaacccagcactttgggaggccgagccacgtggatcatttgaggtcaggagtttgagaccagcctggccaacatggtgaaaccttgtctctactaaaaatacaaaaattagccgagtgtggtggtgggcacctgtaatcctagctattcaggagcctgaggcaggagaattgcttgaacctgggagcagaggttgcagtgagctgagattgcaccactgcactccagtctgggcaacagagcaagactccatctcaaagataaaaaaaaaaaaaaaaaagaatacctgcctcctacccccagagattctgacattattggtctgggggcacagcctggatattggggttcttcaaaataccccaagcgatgctagcagaaccgagaaccactcacctctgcaatcccattttaaggctgttctcctgttcaaagtcctaatgtgaaattggaaacaatttataagtcacattttttcgaactacatttattatgtgaggcaatttcaaaggcttttaaagttataacaaagccagtaatctcttgatttcaaaatggataaaagctctagaagtggctcttgccgactggcaaatcccccaagttatcgttgctgtccttgccttgctcttcattgaagaatcccagtgtctcttcatagtatcttatttatttatttatttatttttctgagacagagtctcgctgtgttgtccaggctggagtgcagtggcgcgatctcggatcactgcaacctccgcctcccggcttcaagcaattctcccacctcagcctcccgagtagctgggattacaggctcgcggcaccacgcctggctaatttttgaatttttagtagagacggggttttgccacgttggccaggctggtctcaaactcttgacctcaggtggtccacctacctcggcctcccaaagtgctgggattacaggcatgagccaccatgcctggccttcttcatagtgcctttagtaccagtactgtgtatactaagacagattctttagtactactacatagtactggtactaaagacagattctttagtactactacatagtactggtactaaagacagattctttagcactactacatagtactggtactaaagacagattctttagtactactacatagtactggtactaaagacagattctttagtactactacatagtactggtactaaagacagattctttagtactacttcatacatagtactggtactaaagattaacaacagcagcagcaacacaactggacactcctgtaggtctttgcggttgacgaagcaccttcgcatacatcatctcacggtgtccccttgaggttagtagaaaagtttgtgttatcctcactttgctgaagagaaaactgaagctcaaagcaatggagtgactttctaggttacccagaaagaaacagtaccaagatccagaaagtgcttatttttggcttggacagtttgggtaatttccaaattcacacagctggaaagtggaggtggtgagattctagaactcgtgttcttaaccacttccccaatatttagtcctgaagcattaaaaatggttttcttgttgttgctgttgttgttttagagcctgggtctcactgtgttgcccaggctggaatgcggtgcctattcacaggcgcaacaatcatggctcactgcagcctcgaactcctgggctcaagccatcctcccatctcgacctcccgagtagctgggattacaggtgcatgccaccgtgcctggcttgaaaatggtttttacacaactttgcatgatttgttcatcctgggatgaatttatatccccaaagcactgtataaagataaagagtgatctaaggcataaaagcaacagttctgctgatttaacctattagggtttaagttgatattccaagagaacacgctgttgaaatgcaccttaatagcattccttagttcaagaaataacaagaaacacattgatcttgccaagaggcctcacatttacaagatcacagggctgtaaaaaacatcaaggtaagttagagatacttttgcaatgatgtttgtgatgtgatgtgtgttagtctttaacatccgtgtccagtgtgacctatacccttttgttacttttcttttagaagtgaacagagcataaagtaaaagttactctaatgttgctatagtatttagtacagcatagagttttttaatttgaagaagagataaacaaagatataaaatggcagtaattttgctttagtgtgtaaattagaattgcttataattatctgattaattgaatgaacaggaattgaacacatagctctgttgtctttcaattatgtagacatttttgccttgctcctaacttgaaatatgatttgatattacacagattgggattcacagtgaagtctaaccaattctgggttttggtgtacacaagcagaaggagatgggtttgaattagtgagaagttttcagttacaggatgttttcaaagtagagttttaaaactttgaagtgagttgcataatatgactagaatgtaaactctctttgaggccagggactttgttttattccctgctataacccccgtgcctggcacacagtaggccttcaaaaatgggattaaaagaataaactttggcaaatgacttcacatttctgagcttgtgtttcctcacttgtggactgaaggggttggactattttggtatctggtattttccccacccatgacctattttgtaattcttttcttccagtgaactccaagccctaaaagatgcttttgcacaatttatttaagtaagattgttctcatttttggtgttgagtaaaaacatatatgacagtatccagtgtttgtgatcagcagtagaaaaccagtattgatataatcccaaacggtacaaacattatactctatttttattttatttttattttttagagacagggtcttgctctgtcaccaggctggaatgcaatggtgcaatcatagctcactgcagtctctaacacctgggctcaagcgcacctcccacctcagcctcccaagtagcttggactataggcatgcaccaccactcccagctaattttaacatgtttagtagcgatgaagtctcttcatgttgcccaggctggtctcaaacccctgggctcaaactcctgggcacctgcctcggcctcccaaagcactgggattacaggcgtgagtcatcgcacccagcctcagcctcacactctaatttttgtgtgtgcagcctattgtggataaataagcgatttttgaaatgatgaaagtaccgtctaaatgactacctttgcaaaacgtacagtattgcactaggtcatcttcaagtctcctttacctctgaagtggatttctatgaacttcagtttcctgatgtgtaatacgaagggatggaaccccatgatctttgtaggaggtgccttcctatgatgatcctaaactatggaaacttgaattagatgagcacagtgttctaacagacattctcactaacctagtgttagtgaataaataagaatgttttatagtcagaatggaaatctcatgcatgtaaatcctggaagaaaccatcttcatgattttttaaaatgccctctacaaattactgataccacattgtttgcattaagtgagaaaagtagtttattatataatggtaaactttatccaagggcacagaatcatatagtctgaattaataataattacaccttattgttgaaactgtgataaaatgcttgataaatgtaatataatttcattcaaagaaatcactcccattttacagataaggaaatacaagcagaggaatgttagaaacttactcaaggcagagccaggatctgaacccaagtcagtctccttaatcacatttaaggcttggctcagcaggcatgttcatttattcattagaaataaatgaacacagacattttattcatatgtaggagattaccaaatcagagttacagattattaaaagtgagggatctcagatcaaactttcaaagctcatgacaagccaaagaaaataggaggagaagacattattagaacaggagctaccaatgtataaaggctggctaaggattttctgaaggttaagggttaacgtggcttcaaaacagaggcaacttaaaaatacaatttttccaactaagtaggatttctatgcagcaggactatgcctaattccaaccctcttaatggttttttactagcatgtagttgtttatagaactagttcctcacataggagtcccactttcaagggtcccggagaaccacgatatgaacattcgctaggagcaaagctgatagggtgagtcataaagaaggggctgttcatattcagcctcaaagtggcaaggacttctcctcctcgggttcatgctgactgcctgacttttgaccttgtcaatatcatgacaaagaacaagagagaaaatggtggctggggagagtgattttagcattaatcttgtcccacccttagtttaatgggcattaattacttcacagcgctcaaattaaatctgatgtggcagagactggctggcaccaaagcttttactttttcttcctcagcacacagctaggctacatttcccaacctcccttgtagttagaagtggccgtgtaactgagtgctggccaatggatgtgggtataagtgatgtgtgccacctccaggcctggtcattaaaaatctcccacctggccaggtgcaatggctcacacctgtaatctcagcactttggaaggtcaaggagggtggatcacctgaggtcaggggttcgagaccagcctggccaacatggtgaaaccctgtctctactaaaaatacaaaacttagccaggcgtggtggtacaagtctgtaatcctggctacttgggagactgaggcaggagaatcacttgaacctgggaggcggaggttgcagtgatccgatattgtgccactgcactccagcctgggtgacagagtgagagagactccatctcaaaaaaaaaaaaaaaaatctcccacctgattcccatcactctctctctttccccgtttgcctgccgcatcgtgctctccagagcaaacttggaatctgcatctgacacatggtgagaactcagtaaatactagtaattatcactatagaccagtgctcatagaacatttttttgcaataacggaagtgctctatatctgtgctgcccaaaacagtggccaccagccacatgtgaccacagtattgagcacttgaaacttgactggggtactaaattctaattatgtttaactttaattaatttaaatttaaatagccacatgtagctaatggctaccatgttggacagcacagttatagaccatttaatctaattgcttcagaaggtttctatctcaaactgtgtaagtcaggattcaatcacaggagaaccactaaggtgcgtgcacgcgcgtgcgcgcgcacacacacacacatacacacacacacacacacacacacacacacaaagggatttgctacagggatttgtcctaatacaactgtgggagctggttaagcagtctctataaagctctcatcttcacatctgatgttgggactcgacatctatcggacaggcagttgggaaggaaggataaatgtaaaataagggagagcaagaacaacctggaaaccagaagcatgcattgtagcccacgagaacagactgagccccacgtcgcttattgttgcttttgaccttggcagtatggatatcctgcagaagctgggcgcttcatcataaagtacacacatggccaaggagccgaagaagctgaaaaggaaaacccaggagaaggtggagcagttacaggccccgcacctccctggtcctaataagatgaggcaactgatcattgccaacctatgtgagctacaacatggctgctgcccacatctgcccagatctcccacaggaaactctcttctgtcccacgttaattagaaacatgcaagaaagggaattttgggaaatgtagttggtctaacgaagatgatgcattatggagccaccacacatgctagcatgctaatgagctcaattttctatctgctaatacttctaaataaaacatgaagctaacatctcccaaggctctgttttgttgtttcagttctgcaactggcctagagaattctgaagatccttgcagccagctaacgttatctttgagtggtaagattaggagtacttttcaagtttttccttatatttttctgtggcttagaattcttcccacataaacccacattatgattgtaatcagaaaaaaattagttactttttagaagccagcctgtgacccctagggagaccatgcatcccacttaagggcaacccaataacatcatgattaactgtgtcttctacattcttcctggaaatttcacctgttcttgactttgtacaagaacttataaaacgtaagttatggtcatcagatttcctgaagccctctgcttctctcctcccatgttctcaaagtgatcccaaggatattttagaaactggaagcaaataatataaggagaaaagaaactggagtggaagtcttgcacgtagaagggagaaatcatttttagataagtcactgggaaagtgaagaatagagagcgcatccttgatatggtttggctgtattcccacccaaatctcatcttgaattgcagctcccataattcttacatgttgtaggagggacccggtgggagataattgaataacgggagcggtttcccccatactgttcttgtggtagcaaataagtttcatgagatctgatgtttttataagagatttccccctttcacttggctctctcttttgcccgctgccatataagacatccctttgctcttccttcctcttccaccatgattgtgaggcctccccagccatgtggaaatgtgagtaaattaaacctctttcctttataaattacccagtcttgggtatgtctttatcagagcgtgaaaacggactaatacagtcattgtattaactactgacttgagcagtatttactgtgtattcttctcaatactttaacagtagtacctatgaagtatgtcctgttacacttatcttcgtgcctgtttttcacctgggaaactgaagtgcagatgggttaagtaagtggtcaaagttacatagttagcaaatggcagagccaggatttggacctaggccgtcctggtctttggagtctaggctcttaacctacctgccacactgccttctttaggggtgcaggacagggtcacgtggactatgggagttcgatagattaactgctggcaggccgattcctgtttcttcctcactcccacatcccagtgaccccccctccgccccgcaaaatcctctcacttttaccttagtaggatctgttgaacctctcttttcatgccagcttcccaagcatgggttcaagtcctcatcgtgtcttgcccaatgtacccctgtagcttactctctggccttcccacttcagatttccttcatttatttcatagttatacaaaaaatattgttctgtgtcaggaacaggggcaagggggaagggagaatggggagttattgtttaataggtatggggttttggtttgggaagatgcagaagttctaaaaagagaaggtggtgatggttgcataaacatgtggacatacttaatgcaaccaaactgtacacttaaaaatggttaagatgaggccgggtgcagtggctcatgcctgtaatcccagcactttgggaggccgaggcaagcggatcacctgaggtcaggagttcgaaactagcctggccaatatggtgaaaccctgtctctactaaaaatacaaaaattagctgagctgagcatggtggtgggcgcctgtaatcccagctactagggaggctgaggcatgagaattgtttgaacctgggaggtgtaggttgcagtgagccgagatcgtgtcactgcactccagccagggcaacagaatgagactccatcttggaaaaaaaaaaggttaagatggtaaattttatgtgttgtatatacatatgtatatatatataaacgtatatatgtgtttatatatagacataaaaacatatgtatatatgtagcatataatttgtggttttatatatataaataatatataataaatataaaaataataattgttctgaaatgtaccttaaaaagcctctactgcatctccttctccacaagataaagcccacatttcttagcatagctttcattacttgatcatctggctcatgtgccatgcaggactgtagcttggccaccatctttttgtgccgatgactttgtgatcaaccactcctctttggcccttctcctggaaagaccccatagaactgagagctatcattcagccttgccgattatcatggaagtagcaggaatgatgggttaataaggagatagacttacagacagcctctcaggtggccagacagcatagagtgaatggagatggtatggcttagtgaaagaggtatgggctctcaagtcaaacaagtctgagtctgagttcaggcttaccattaaactctccatctgtgaaatgaggatgatcgtttcctattgtagggctattgtgaggattattagcaatcatgccccagatatagtgggtattcaatataagatatacagtgtgaattctctttagctcagactcagttaactaagtttggaaagaaagacatgggtggtattccagttatctatttctgtgtagcttaatacaactgtcatttagtttgctcacagatctgtaatttgggcagagctcagcaggagggctcattcctagttcacatggaatcaactggggcatcttggctgagggctggatcctctgcttccaggatggcctgtgcacacatctggcaagttattgctggctgttggctgggagctcagtggaagctgaggactaggaacctcagttcccatgtggcctctctacatggcctgagttctaaggataagagagagggagaaagagagagagtgagagcaagcaggcagaagctctgttgccttttgtcacctatcctctgaagcccatagtgttacttgcaccatattctcttagtcaaagcccacccaggatcaagagaaagggacataggttctacctcttgacagaagagtggcaaagttctggaagaacttgtgagatgagaaatattgctgtggccattcatggaaaatgcagtctgccaccaggagttttcagcttctaccttaaggctttggacttggaacccatagggaagtgatttctgaggtttacagagtgtcatggggccgggcgcggtggctcacacctataatcccagcactttggaaggccgaggcgggctgatcacgaggtcaggagatcgagaccatcctggctaacacggtgaaaccctgtctctactaaaaatacaaaaaattagccgggcgtggtggtgggtgcctgtagtcccagctattcaggaggccgaggcaggagaatggtgtgaaccaggaaggcggagcttgcagtgagccgagatcgcgccactgcagtccggcctgggcgaaagagcgagactctgtctcaaaacaaaaagagtgtcatgggcaccatgtgcgacatggaaccaggaggtgggggacatgagttttaatcgtatcaccacgcagcagtctcctcttacacaaagcactcacctggagccctggacttgtcatttgtaaccagatgatgccctcttcagctttactcttctccagttctctgagactgtgaggtccgggcactgtccattccaactccgacatgtcagccatggctgaatcagtgcttctccatccatcttcttttcacatcggaattgctagaggagctgtcaaaaatgcagatgcccaggttgaaatgatcaggggtgggatctggacatcagtcatttaatttaaaaaaaatttttttagagatgggttcttgctgcgttgcccaggctggtctcaaactcctggcctcaagtgatcctcctacctaagcctcctgagtagctgggatttgaggtgctagccaccacgactgactacatcagtaatttccctgggggtgatattaatgtgcagccagggttgagaatcggtgagctccgccattgtgtccatctaagtgtgtacaggagtcaatcaaaggaacccaagtgtagccattgcttttcgtgcccctgtgacatccttttgagccatctatgagaccagccacagaagaggtggacagttctatgctcgcagacttctgtctgcctctggggtttcccccgagccctggcagcctgctcagctgtcacaggaagagcccaggagtgcagaggaagtaatggcccaggagcaaatgtcaactgttggggagggagacttggataaatgccccagtctccagcccttcctagagacaattctagaaggcattctctatgcttctcagaggtctctttggacttgagctcccactgtccacaacaaacaccccaaacttggcttccatccttccctgtctctttctccctgcctcctgggattacctcccaaagaaagtacttgcactccagtcttgatcttaggccctgcgacccagagaacctaaactaagatgccaagtgatcactgctcaattgtgaactggcaaagagtggtgtgaactaagggaaattggaaaaactgctcgccacagccaaaccactggtgcacgcacccctgccacctttccaggcacttctgcacttaaaactcccacaagcgactcttgctaacccatacatgacagatgctttgatgagaaggaaagtgtcagctggctagcagcagaatcactctagacactagtggagttggggaggagagggttctttcttcacactctatcttttctggaggaagcagagataaccctacagcaggggtgtccaatcttttggcttccccgggccacattagaataagaagaattgtcttgggccacacgtaaaatacactaacatgatagctgatgagctaaaaaaaaaaaaatcacaaaaaaatctcatagtgtttcaagaaagtttatgaatttgtattgggccacatgtggcctgtgggctgcgggttggagaagcttgcctaggtcatgcattctcagtggaggcgctatcatccccattggggtggaaaattggttcttggtagcaaaacaacaacaacaaaaaaaaaaaaaaaaaaacacaaaaaacgcttatatatgacacagggccaggactaggatgaggcaagtcaggggcccagggaagaaaatattaaggagacagccactcccagggctgtggatgtccgcatatggataaacatattaactcgccagatggcaacgagcctgtgcataaagagatgaaaaggatcaggcagaggcagaaagtgttgcagtttgaaatagactggtctggaacagcctctcggagaaggtgacatttcagtaaaatgtgtaggaggctctgtagcaaaccaaggggccttctgggggaaaagtgttccaggcaggtggaacagcaaaggcaaaggccctgaggtgggaatatgcttggtgtgttggagaaacggcagggaggccaggatggctgagtgaggggagggcaggagaagataaggttggggtagagagctgtctgtttcatggaaatgttggggcgattccattgagtgaggagcacaggtataaggccagtgtcatcagtgtccaataaaggtgagtcggcctcccgctttccccactcccaaagcgctaagcagcatttacatgtcgtcagactgaaatagctctagaagctaccagccttcggaagttacaccaatcacttcggaagtgaacagaaatcatggctagcattctaaatgaaaagcacagccatgacgctccattatcagcacgggccaggaccagcagcgtagattgctagccatgtgtctagtttcagaggcactgggaagggcggggaatgatcccccagtatcctctactggtcagaaagttaatttcaaggctctcattcttcctaaagtacacatccctcctggtggagcacggtggacacccagtaggtcagtggcccttccttctcttcagcccacagcccaagatgagaagcggcctggtgtagtgaagctggagagcctgcctcacatcctagtctgcccttttacatgtaatcttgggcaagttacttgactgctcttttcctccatttccctatctgtgaaatggggataacgtacctcatagggttgttatgagggctaaatgagctaatatttacgcagtgcccggtcatatagtaatgctgtataagtgcttgttaattaaagatagaccccctttgggggctctaatcttcccaggaaaaaatgcatatgaacacacatttgcattttatttcggggcatttatggacgctccaaaatgcatctcgtggacccttggggaagggacagttcataaagccctgagagaaccaggatgagttctggagggatcaagagccagggggatgggtgggcgatactgtgcgaaggcaggagaaaagcaagaattgggggctgggggctcaagaacacatttcaccttcttcccgttctggccaaagcccacctagaactgcggattgcttgcactttgggaagttccatcagctaagagccgaagttttttttaatgatgtcattattaatcatttaataaatacattatgtaagagtacttattgagcagtgtcccagcgcgagtaaacatgttttggatatgccaaattagaaatgttttcattcagttttgggggttatgtagtaaactcggaaaatgccgttcctggaagagtgtctgttatcccaagcccttaagagccagtgtaataacaacaaaaatattgttctgtttggggttcccatataagagtgcctaggcgtggtggcttgtttttaattatctctctatggaacagtaattcaatccagaggaggactgccaccagattacaagtttcagttgggttgaaaatattcatgcaaggagagctagttgtaatctttttagatccactcccaaaagattaagcctttttctttcccatccaacttggggaagaatgtggtggaagtaaatactcatagtagtaccacaatcataggtgtaagacaaccatctcacatttgaagtcttaatatctaccacggtgtcaaatagcagggagaaaaatgaacacttcagaaacacccagacatgatcttgcataactttggtgcaggtagtttatttgggaggtgatcccaggaatcaggagtgaaggagcaggcattaggaaaagagagaagggagaaggcattaagaaaagaggaaaagtcattaacaggtatgttattgaggtcaccactgtaggcaatgggggctcacaatggctgactttttaatgctgtttttgatatgtatttgggtggacattttagcatacatttgtaagacctgttaaggcatctatctgctgtgatcggcagctataactactcctccaaactttgaaatctgagtcatagtcatccaagaagtattcttgagtctttgctctgttgactctgcattagtcattttgccttgttactttcagatccattccccatccttcccttactctgtatcacagggacctgaccccttgcaatatctttcatgtctccttgccaactggcttccagctaggttcggccagtgggtgtcagtgacaggagattggagtgcaagaggaaaggggaagtcagggtatttctccccctctctcggtttggctggcatctctaatgggggctgtgcctcttccatgattccagtctcactggacagaccccttccaacatcccgtggcctgaactcctgccttgtggctctgttcatcggtatctggtaatattacctcccccctttgctcttccagaatcttcctgctgttgctcacctctggattgctccagttcttcatctttgcaacatttccctgtgttacattcctgctcttgaactacctgtcatgggttcccaactgatctctgactgacggagatttcttaaggatttcattagtcattgcaaaaatattttaggacatcaaccacaaacaagacactggactagattcctggaaggtaataaataaagcatcaagcagcttagcgtctagttgggtaaacaaggcacacagtggaaaagttaaatgacatctttccaaatgccaagtgaaagaagggcgtagtcaatgaatacttgaagatataaagaggagagagccagctccatcagcttttgtaaccagggcatgctttagagggccagggagccgacataaaggggtcatctcccaaaacttacaattttgtaaaacaaggtgaaaaattggaattttatttgaaatttcctgatttttaaatgttggtgagtaattcaaattttcagtaacttggagctgggcatggtgccacacctctgtagtcccagctactcaggaggctaaggcaggaggatcacttgagcccaggagcttgaaacccccatttctgaaaaaattttttaaaaatatccaggtgtagtggtatgtgcctatagtcccagctactcaggaggctgatgtgggaggatcccttgagcccatgagtgggaggctgcagtgagctatgattgtgccactgcactccagcctgggcaacagagcaagaccctgtcactaaaagaataataataacaaaaaactccagcatgattcccactatgtagacaagataaaacttgtttggaggctgaattgagactgtgggtgtacaattggtggatggattactgtatgggggaagaaatgggatgcagagaatgttaggattccttccaattagaaggttctaaggttctaattttacacccgggtatgaggcagtgacggcctgggtatggaagggggcagtgagcatggggagaagggacagatgagagagagattaaagaagattaataataaaaccctatggccaggcgcggtggctcacacctgtaattgcagcactttgggaggccaaggcaggcggatcacttgaggtcaggagttccagaccagcctggccaacatggtgaaaccccgtctctactaaaaataccaaaattagccaggcgtggtggcaggttcctgtaatcccagctactcgggaggctgaggcaggagaatcacttgaacccgggaggaggagcttgcagtgagccgagattgcgccactgcactccagcctgggcgacagagcgagactctgtctcaaaataataataataataataataataataacaacaccccccatttctgtattcgattatggtctacagagtttgtcattggaactgggatagagtagagcctcagaggttaggctcagaagtcaaactgccttcgttcaaatctcaggtctacaagcaatgatctgtgaggccttgaacaagtttctaaacctcacccatcctgtttctcaagcactaacaaggaatgatgttaatgatatcacctacctcttcagggtcgaggagtccttctcatggcataactctgacccactcttctgcctgcctcttccacttttaagaactcatggactagattgggcccacccaggtaatccaggataatcgatccatctcaggatcctcagtgttcatcacatttgcaaagttgttggctgattaaataataaagtatgtttgaagtccttcatgtggtaagcctggatcacaggaagcgtggatcagtttttgctattcctgttatgccatgtacattctctctttgagaatccttgcaacagccccatgctacaatgagaagactgcccaggatgcaatgactggatatggaggtgggagttggggatggggaggagtcaggagcaatggccagagagttagcatcttggtttgtagactcgactctattgttaaaagtaactctttgtttctgggctcttcacttgacccctgtaggattttctctcttgaagggcggttccttgcaactcattctccataatttaggaaactgggtttctgagtatggtggaaagactgatggctccccaaaaatgtccacatcctaaaatccctggaacctgtaaatatgttaccttacatagcaaagggaactttgcaggtgtgattaaaatgaaagaccatgagattatcgtggactacttgggtgggcctaatagctcttaaaagtgaagaggagtcagagtgatgccacctgagaaagacctggccctgtcccatcatggctgactttgaagatagaggaatggggcatgagccaagaaatgtggggggcttctagactctgggaattgaaggaatggccctcaatgtattgctagcaagaaaatgaggaccttggtcctacaaccacaaggatctgaattctgcttatcctgaataagcaggaaatggattctcccctagagtttccagaaaagaatgtggcctagcatcatcagcattgattttaatctggtgagactcctactggacgtctgacatgcagaactctaagataacaattttgtgtttgaagccagtaagttaatggtacagcagcaacagcaaaccagtactgaagttttcaacttaaatgtttggcgggtgttactggcaatacttttgagttcaggaactgatcaagggtggaaatgatgtggggtgatgagggatgagttcttggatatactgagttggagaagcaatgacagcaagacattcacatggcagtgctcgaaccacacttggccatgtgggattagagtttagaaggtagtggcaataactgaaaaaaaaaaaatgcctgggaggggatgtagggaaagagactccattgatggggccagtttcttgagtttccagttcgtctggctccatttggcttctattctaagccaaactcctgctcatcctaattggaatatatggactttgttttaaaaaaatcactagggagtcatactgagtaaattttatagacacggcaccataattttatttattgacttaaattgagacttccataaatgaataatgcttgaaaattggctctttgtaggttccaaaggaaaatctgaaaattttaaatgtttttcctttctttgtttatgaatctttttaacaatggaaatgttttgtctcctaagagtggcatggagctcaaatatatgactcactggatatgacgaccacctctttaagttgtaacaaatgggaagtgagttaggagagggcccaagagaaacataagctgatcctcagaaaagtgtaagtcctgtggggatacctctaggttggaccaggagtgaggtggagcatcataatgagagacagaaaaagtgaataaatgttagtgactgagcagctgggttcctaaaggaaaaagaaatgccaaaagaaaaaagcagagaagaatcatttaaaaatctctagctttaatttactagattccctcccttcatcaaagtagaccgctgtctttcctgtcaggagttactgagagccctgtacatttcatgatgaaagagaccagccctgggctggtccaacccctcatctactttttttttttgaaacagagtttggctccgtcgcccaggctggagtgcagtggtgtgatctcagctcactgcaacctccgcctcctgggttcaagcagttctcatgcctccgcctcccaagtagctgggattgcagatgtgcaccaccacgcctggctaatttttatatttttagtagagacggggtttcgccatgttggccaggctggtctcgaactcctggcctcaagtgatcctcccacctcggcctcctaaaatgctgggattatagatgtgagccactgcgcccagccttatctacattttgatcaagtttcagctcttgattataagcccacgcctatcaaactcagggatggaggaccagttttgtgagtttcccagaaaacttccttctctgctctggctcttctcttacccttgacttgtccatttttttctaataagtaagaaagaggtgaaactcaaatcagccccctgtgtgtacacagctgtggtcaacagatttggcagtggagaaggttggaactatggccatccaccgggcaaaattgtcagtgaagcaatgttagcctctgttgcccctcgacgtcactctccatccctcttctctggtacctaactcttcccaggtgccttcatcctgctccccgcctttgccaggtgcctgcccttcttcactttacctgcccacactgacaggtgtcattctgagggtagtccatattgaatgttgattttacccagggctttcccacgttgcccagtgtggtagctctttgctagatgatcagatgaattcacccaattcaaatgaactcatactaagatgtgaatgactgatgaccccttcagtgttcccaaaggtattttttcaattaaccctttcaggctgggcatggtggctcacacctgtaatcccagcactttgggaggccgaggtgagtgcttgagcctcaggagttcaagaccagccctggcaacatagtgagacccccatctccacaaaaaataaaataaaaaaattagccaggtgtggtggtgcgtacctatggtcccagctattcaagaggctgaggtgggaggatcacttgagcctgggatgtctgaggctgcagtgagccacaaccgcaccactgcactccagcctgggcaacagagtgagaccctgtctcaaaaacaaaattaaccctttaaaagctaactcaacagattagtggaatattaaagtagcatgagagatacagaagaacagagactaaggaagaagtaactgcaattaaattagggcaccaaagcacctagccacttgcctacatttgccttgttggctgcagggttattggggaacttgggcactcattcagtcctgctttcgagccgaactatgattttaattatcccagaaaacaatcagtaccctaccatcatttcaagaaaataggctcctggaggctaccaggtatgtttcactgtgcaatgttagtttgcaaacatacttattctttcctattaattgtatctcaagataacattgtaaaaatatccctttgtaattaatttttttaatgtataagataacaccccatgtgggtcagtatttggggatgtaacacttctaaagggtagtataaattggtccaagttttctctagggcattttgcaaacaacatttatggaatttctgaaagaaatagccacatatgtatgtaaaaatttagcccaaaggatttattgcagcattgtttgtaatcatgaaaaatcatacacaccaaaatgcccattaagaggaaatttgttatatagataaatagtacatacaacaattgaagtgctattcagccatcatagatggtgttgtggaaaattgtttgatgatatagaatgacgttcatgatatattgtcatgagaaaaatcaagttataaatatttttgtgtgatataatccttatacatacatatatatacatataaacatatatgcatgtatctgtatatatgtaaatatatacacatataaacacatgcatatatctatatatgtaaatatatatacacacatagagaaataatatatactaacatgttaatgtcatttttctctgagtggtgaaattatagatggtttttattttcttcttcttgcttatctgtaatttctcgtttctccaatatgtatgtattattttcatagatagaaatatagaattacttttcttttaagagatctgagcattttccccaaataaataactcagcagctcttgtagtttataaacccagaggtgtctgatctagcttaactcataagaaagaaatggcttaatagatataacgtctgtgctcaaaagcagcacagttaatggaagtttaatttatgcaaacatacacgttaaaaagtattgattaggctgttgaaaataatagtaaattaacatactgccctcttttggtagctatttgtaattcagcttacgttcacttccattaaagatgttaatctcctacaaatgtgtgcataaattaaactaattttatcttattttttaaaataaattttattgtgcacatttgaggtttataacatgatgggatggagtacatatggatagtgaaattgttacagtagtgaggctgataaacattcacatacttttttttagtgacatgagtagctgaaacctacttatttgacaaaaaatccttaatatagtacaattttattgattttagtcctcatgaaactaattctgaatcacctcttttcctcaacagaagatactgataattccagtttgtcaccaccacctggtaagttgtttttttagaactctggggaatttcaggaaaatattattctgtaagttctctatgaaacatggcatgtagtcaggtacaacaaaattgttttcctccaagaagcttaattaggtcattaagcctacacctgaaaaatcaatgcaagcatagaccagaggacagtcatattgatccgtccatattgcgggacaaagccaggcaacaaatcacaggggactaaattgttagttttcattacagtaattacttaagttcagcagttatttttagtattctagttcacaagtctcttgaagagtatcaggaacataaacatgccagatgtttttacatttaagggaggagatgagatgagatgttcacttaaatatacaccctcagtacctccactgaaaggatatttttcactaggattctaagggcccagcactcaccagaatgggaaggcaaatacattagaacccagattggcaagtgcctggaacagaacctgaattcgagactgctagctggaatgggaccttagggataaagtgacccagccctgtccattagttgatgagataatgaagcctggagtggctgaggaacttctctaagatcacacagctccttgctccacatcacacagaggcagcacatggcttctctgactcctacttctgtattcttttgggtacaccatctattccagaacaatcttttatgatggggagtgagtcaactcacattctttctgtagttgtgtgcaaatgagcttctactgttattgattcattatttaaatccaattaatcacaatagctatacttctcatgcactactatgtatctggaagccttcagacatctcctcgttctcctctcagtcttgcagcataggaaatattcgtgttatagatgaggaaactggggcttggggaggataaaacatgctcgtgttcacacattctctggagccagatgacttgagttgtaatttggccaccaccttcctgccttcattcctagctgtgtggttttgggctagttcctttaacctttccatgcctcagtttcctctcctgtaaattagggagaataatagtagctgttgtcgggtagttgtgaagacggaatgagataacatatgtgccaggcacagtgtaaacccttggtaagtggtaactattatttttacgagtttttgagtaatggggcaaagattcaaacccaggactgcaggcctccaaagtccaagctcttttgatctcgccaatttgccccctagttgttaagcttctagggcacaatgaaccactatatttttcttccaatagaatagtccttagcaaactgaatcatggtgatatctgcaaaaccttgtttgcatagaatagggaatgggactctggggggacacactgggtctagtcacagcctggcttctgggtgccctgggggagagcagtgcaaactggaaggtaagagccagtgtagcatcaagggatggatgggcagccatgcccagaggtctcttctttgcacagtgtcaccattcatcaacattcggaagaattaatagtcattccttaaaaactagttgtggccaattattttgttctgccccaagagcaaaaaggattctatatctacactttgaatcttattgctcaggaactgtcttacttctcaagaaatatccttggtaatttaagaaataaataaatgtagtaaatgacaaaatatggaaacaataatgtggacagacagggtgtgtgtgtttcagccaacacaagagcagtctaaagcaggccagccaaagtgccttgacacacccaactttggtccataccagctgaaaatcaggctccatactgcaaaacttattttagttataaaatgttggtgtttgcttttcccatgtttaggtagaggtcaagccattgaatcttttaaatatttaaatatgcaaaatgtgtgtagtagattgacttcttagcttaagtggagtcattccacaggaaatttatcacttgattaattgccttaatagcagccatattttaaaataacttaccaggaaatctggttaggtagtacagtattgagtggtagcaatttttttaatcctaaatttactgtgggaagatttgctaggcatcactgtaacagaatggcaccagcgtgccaatatatttcatgattgtaattcggcaagttatttaaaatgttttctagaatgctctggctgaaaaatttttaaagtagtatttcttgtattttggtctggttcctaatcttatttctataatattccataagtagttagcaagctttgcaatcacgggtctcaggttcactcatcttgggttcttttcctacaattctctgattaaattttatactcactgagcgcttatgggacatgcagatttaactacaacttggtctgctagtgtgttttctacttcttttcgtaattatatctcaaaagttttaattctttaaaatttgacaaataatcgtttcaaaatattgatttaatttttttttctcctgcagctaaattatctgttgtcagttttgccccctcctccaatggtactccaggcaagattttgaaaaaatttaaacctagatttagtccaatttgttaaagttttgttttaattatatctttgtattgtttttctcctcgggacaaaaagaggttgaaacaacaagcctcaatggtaagaatttttctgaagcaagtgaaaattgataacccttaatatgaatataagtataatgaatggtgttgaaggtttccatttctaaattatttctgaatacgtcgagtagtttcaaataacccaaaacaaaacttgccaaccctggagagtgacctaaactttctggttaaatgataacattcttacagtcatggagggaagagagcagtccaccactctaattgttagctaaaaataaaagaaatatcgatcacattttgaattatccattcccttgctgtccaacacaatgccaacaagttttacatgacagattgtttaaatgtgaaaagcacatccagttattcaatatgattcagcatggatttggaggcacagtgtgttcaaagacagcctttttacagatgatttgatcaatttttaaatagtatgaaatgggaaaaaaatggcttccctatcatgctagagaaaagggcaaagaagtgggctttattcaagggaagggggcagagcagtacattctgttccctccaataagtgaacagaatgggtagacagccttccttccatcttattgcgatgaaaccccaacacttttcacaagcccttggttaaaatcaaatctcaccatatggttggtggctaaggagctaaacaatcatagatgcagcttatactgatcaaaactggtttaaattcatatttggcccaatgggaagggacagatgttatcatttttatgtgcagttacttctcacagtgaaaataatatcttcaatttagctttggtgcagtttttggatcccattttgtgtgtgtgtgtgtgtgtgtgtgtgtgtgtgtgtgttttaagtatgatgtaataaatgccttttggttttttcctaaaatttcatccagaatcataaattctagaatgatttggatttaaagaaatgccaatagaatcgattttaaattggattttaaatcaaacaggatccaaatgagattttcttaaaagttagtcgaatataatggtcatttactccaaatttaagctagaattattttaaattgctttataagagtgtaccactggtaaaaatgtattatgcatccacagggctatatattaaaatcagtattaatgttggaaatgtcatatcccttagggacgttcattataatagagaaaaaagggacaaaatattaaacaacatagatgagtttattcaaatctaatggttacgggagtgttgctaagtgtttagacatgtaacttgcatttgaatcaatgaacatttgctccggaattgtctccaggggttggagaatggagtagtgagaggatgggtagcaaaaacatttagtagtgtcagttggcttttgcaaaactaacttctcccagatttggggaaaagggaaatgtttaaggaacctaggaagacacacatgtttgtaaaccatgccagtagttatgctaatttttattattttatttcagatgttactttaagcttactcccttcaaacgaaacaggtaatatcaagtgatttctaaatgtaatagcttcttctgcagcctcttgagtgtcttgcttgtgcagtctactgggttactaaagagttttcttttgcctccttgccctttttcctgtgccttcaaccattgatttatgacccctttgactttgacattgaactataattctgtcaccacactcccaaacttccaaaggatggccatagcactccatttaaaatagcatgtattatttttgtgattataatagtgatacatattagctcataaagatggagaatatagagaaatgcaaagaagaaaatacaaatcatctttaatgttactttcctaagactatgactgttaacaatttggtctatttccattcagtatcatttatacatatatttatatacatatactcttatatcctttgcaaaatagtcataatttacatagatttttgtatcttgcccatttgacttaatattacgttagaagtatattccagtgtcccttactattatgacttgataatattccattttgtaccatatgttgaactttaaagttgtttctatctttttaatagaagttattgcaatgaacattctggtgccaacatctttgcattcatttcttatttctgtaagatacattctaaggattgcagtatgcaaggattgcattctaagggtcagcagtatgaatattgtaagactcttgatactactgcttggttaccttctagaaaggtcgtgcctagcgacattcctgtccgcagtggatgagaatgtctgtcactgtacctttgctgagactgtatcatatcttattaaatctttctctcaacgcttaggttttatttttcattcatgattactagtgaagttaaacatttttaccccagagcactttagttaccaaaaccagaagttcatttcacagttgtattttgtttgctctgaaaaggaaactatcagggcaaacaaaataatatatttaaaagatttttttttttttgagacggagtctctctctgtcatccaggctggagtgcagtggcgccttcttggctcactgcaagctccgcctcccgggttcacgccattctcctgccttagcctcccgagtagctgggactacaggtgcccgccaccacgcctggctaattttttgtatttttagtagagatggggtttcactgtgttagccaggatagtctcgatctcctgaccttgtgatccgcccgcctcagcctcccaaagtgctgggattacaggcgtgagccacggcacccggacctaaaagattcttaatgacaatgtgaaatgctatcagccttcataattaccacccatcattggctcatgggtcacacattgaaacctgacagtttcagaaacctcatttgtgtgtctttgttactgatgagtttctgccaggataacatcatcattcttaagtgtgtttccaatctctgagcttggccttttcttcagaatttgcccatccaccctaggtgacagagcttcggtgaaaatctatgccctgaacacagcctctttccattggccatttttacagcaaagatttctgtacctgcttctccgttacctggggaatgaaccatgggctctgtccccaaaacgtgtttggaagacatttctaaagtttgcttcttcagggcatgttaatatttgcctgtgagtcactcactttgaacagtcttggttctgctgtgggcgtgttatgtgattgtgtataggtggatgatctcgacctctctgagaatagcattctctatcagtacaatggggatagtattatgttaactcctaaagaagatagcgagacacttgattgtataatagcaatactttacatcccatgtgtactgtttcacattaatttttattctgaattacctgtttttacaacctatcacctgaaggtcccgatagtggcttaattctacatatctgaagtgtaagtccacatcatttgtctagcagcagtgtgtggaaagtaaagtagaattacacaggcagtggggtgtgtaatgggtgtgatctaactgcgtaaacatggaactccaactcccagactcaccctgtgccaatgctacatgatccgtggatgcggttcctattcattctgctgctgagatgaccgatagtgtcttaaaggtgtcaacagtgtgactttttttttagcacttcactaaaatgatactcatggcaaattgtttttaaaaaacaagcaatgattattctctaatatttaagttgtttctttgcagaaaaaactaaaatcactatagtaaaaaccttcaatgcatcaggtatgacttattatcaatatcaagactttcctttttataactaaagtaaaattaaacaaatggctggtgtttataatttctttctcttttttccaaacttttcaagataaaatctggtcttaacaaacagatgtgtatgcactgggtacctgaaattgtactaggtgtttggggctatataataatgatcagacacagagcctaccctcaagaatcttctagtctatgggtggagacaaggcaaaaaaatagataactaacatgaacatgcatgcagataaaggcaatgattatacaagtattactgacatggttaagaggcataggagtagagggggatgcaattaatgaagaagttagaggaatgaacctcaaatttttttttcctgagacaagatctcactcagtggcccaggctacagtgcagtgatgcaatcatagctcactgcagcctcaacctccttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcactaactcaaattataattttagtttgtacccaaactagttttctcatagaaaagaatttaaggatttgtaatgtgcaatggaaataaacttgcagttgggcattgcacacataattctgaccaaacaagacctaacaaggagacaaaaatatttcttaatataacaagtttttcccttggcagtttgtttaatacattatcagcatttgctcctcccatgtactatggatttcttatgctttgccaaaaggatgcaattaataaaggaaggctttttagagaagtaaaccttgagttcttttcaaattgaagaagagatacacttctcctctcaccaaaggagaaagtgtttctcaggttaatacgtataaagttttggttctgatgctcattttatctcccagtcatctctgtctcctttgtatgcctgtgtggtctgttgtcctggtcatcactccattttgccctcactaataagtaaattaaaaaatgctttttatttactggctagtatcatccactagattgtatgctccttgagggcaggatctatatctggaaactcccaaagcctgtagaatatggttaatgctcagcaaatatgttttgaattttgtagtttttgcccatgaaacaatattatgacattaatgttatttcatacatacatttgcataaagagctaggattaacattagagtgttcatagactcccctacataggaaaagaaggaggatctatgattaagggccattccatttaaagtctctacttggtttgtgttcatggtgctctgtttatactgaacaggagagggattaattgggaaggggtcaaaaattttagggaggagttaaggatcagatattgacatactaaagattagtaaagaattaagttccgtagctgacaaatgaccaacaaatgaaaactcatttctttagtctttgtggaattcatccatccaattaattccagcttataatatttctggtccacatttgatgcctacgtttatgaattctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctccttaaaaaaaaaaaaaaaaaaatcaccatgctagctaaggagttttagaattttgggagtaaagaaggctttcaattttagggaaaatgcagttttctgcagtatgaagtttccacttggaccactgccttaaaccagtggtttgaaatcttagctgcacattagaatcacctggggagcattaaaaacactgactcccaagactcaccaactaaatgttttgtcattttaaaaacatgtttgacggtctgataggtgagaaatggtagctcagtgttactttaatcaacatttccttactaaggcagagtctgaacattttttcatatatttgggggctgttttgtatctttttgtgaattacatgtacatgtcttttctgtattttttctaattgatatctgatccattatttaagagtactttagccgggcacggtggcttacgcctgtaatcccagcactttgggaggccaaggtgggcggatcacgaggtcaggagatcgagaccatcccggctaacacggtgaaaccccagctctactaaaaatacaaaaaaaaattagccgggcatggtggcgggcgcctgtagtcccagctactcaggaggctgaggcaggagaatggcatgaacctgggaggcggagcttgcagtgagccgaggttgcgccactgctctccagcctgggtgaaagtgcaagactccgtctcaaaaaaaaaagtacttcatatattgtgcatattagctctttatatgcatatctatggtatatgttgcaaatattttctcccagtattttagttgtcttttgactttatcatgttttttgtcatggaaattttgaaacaattttatgtagttaaatacgaaaaagttcatcttttccccagtgatctgagatgtcacctttgtcttatactaaattttgatagacatttgggtctaattctggatgttagatgttaacactgggtgaccaagctgcgtgggaggtatacagagctgtttgtattgtttttatagtatttctgtaaacctaaaattagttccaataaaaagttaaaaaaaaatactgattcccagtcaccaggctcagagattctgatttaattggcctgggatatagcctaggcattaaggcccttctggaccaggcaaggtagctcacgcctgtaatctcagcactttggaaggcccaggtaggagaactgcttgagctcaagagttcaagatcagcctgggtgagatctcatttctactaaaaaattaaaaaaaaacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggaggacaggaatgaaaatgttcactgtggttccccatgagtgacctgcctgctggcattatgagttttgtttgttttttttttttactttttcttttctttcttactttgcagcattttctatattcttctacaatcagataaaaattgtatttggaaaaaaaggacttaaaaaaatctgtgtagcttctcagatgggaagagaaggctaagtgtagcctgtctgccctttgtgggccagatttctgggatatactaatattaaaacgttggaccttgaggaacaggtaaaagtctttggttaaggatttgtagcaggattttctgcaatagaaagtaaagagtaacatgccccattcagcttcacatgccccattaagctggagcattgagccccattttggggatagagtttctggaagcattgggatcggatcagaagagcatccctcttttgacgcagccccactgacccctagtggctgcccctagtggttaagaagaagaaacaggaatagaaaaggggtcaggatgtgaaactgatgtccagttagggctcagtcattaactagctgtgtatccgtgttccagagcagatgcttttttaccttcagcatctcagatcaaatgaagaagtgagttagagctctgtaaaattaggaaatggactggatcaacacttctcaaatatcaccgtgcacatccatcactcaggatcttgttaaaatgcagattctgatccagtaaggcctgggcctgaaagtctgcatttctgacaagctcctcaggtgaagccagtgttgctggttcatggaccccactttgagcaccgagggtctgtatagagactgtagagcagtgctagtggttctcaatcctggctgcatgttgaaatcctctggagcgttttaaaaacattgatgcagctgggcatggtggctcacgcctgtaatctcagcactttgggaggccgaggtgggaggattgcttgaggccaggagttcgcgaccagccagggcaacatagtgagaccctgtctctacaaacagtttttaaaaattagccgggcagggtgatgtacacctgtagtcccagctgcttgggagactgaggtaggaggggtcacttgagcctggggagtggaggctgcagtgagtcatgatcatgtcactgcattccagcctgggtgataaagcaagaccctgtctctgaatgaatgaatgaatgaatttaaaaatacatcgatgggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaataaataataaaaaataaaaaataaaaacaaaaatacatcgatgcctgcctcccaccctcagagactggtgtaggatgtggcctgggcttcccagtttttaaaaactcctgggtggggtggttctaatgtgcagccaagttcgagaaccactgggctagaattagatgcccacccagggtctttctaatatgttggttcttaggtttaactgtacattagaaatacctggggtatttttaaaacatactgatgtgtcaaggtggccttctagggtgctggaaatgctctgctttgatctaggtggtgattatatataaaattcgtcaagctctaaatctaagattagtacactttatgcaggctacaccgcagtaaagaagcacattaaaatgccatgcattaaaatgggcactgcgcccaccgccagaggttccaggtcagctggtttggagtgggagcccaggcatcggtgccgaggtactctgaggggttcagatgtactgctggcattgcccaccactgctctgccgcttccctgtgtgcctcacagtggatggagggctctgactagcataaatgacaggagtagaaggcaacctcttcacagttgagcccagtgaacggggccttctgaaggcccccagataagctgaagaaaatttaatgtatactttgcaaagcacctttaccccaacttggccaggtgggttgctacagtgtacagtttagggaatggagcctgagagatgttgggtaaattgtccacaggagtagtgaaagctggagccctagtgaaggttgtttgttcgtttgtttgtttgtttctgagacagagtttcgctctttcacccagactggagtgcagtggtacaatcttggctcactgcaacctccgctacccgggttcaagtgattcccctgcctcagcctcccgagtagctgggattataggcacccgccaccacgcctggctaatttttgtatttttagtagagacagggtttcgccatgttggccaggctggtcgcaaactcctgaccacaggtgatccactgcttcggtctcccaaagtgttgggattacaggcgtgagccatcgtgcccagccaagtctaggctttttgactcatgatgtttctgactgtctgacaccctttatcctcactgccccgaacctcaggggatgcagggaggcctgtggccaagtgaccagccagactggaccaagcaggcttttctttttatagatgtgacttgctttaggccccttgacctaatattcctccctcttctcaccctagagaagctctaagaacacattcttgttggtgttctaagtctccatctgacactagatcgatcagaggcttccttgagtaaatattccctgggtaataatttgttgctcctcctctagttgttcctccctagatctctcaagactgatggatcttgtgccagagagtaggtgaggacttctccacctttgatgcccatgaaaatcaccagagagtttagaaaatacatatgccccatcccaagaccagctgaatcaaacacagaggagtgggccatagaaatctatatacacatatgttttaaaaagtgttctgggccaggcacagtggctcacgcctgtagtcccagcactttgggaggctgaggcgggcagatcatcggaggtcaggagttcgagaccagcctggccaacatagcaaaaccccatctctactaaaaatacaaaaagtagccgggcatggtggcaggtgcctgtagtcccagctactcaggaggctgaggcaagagaatcacttgaacccaggaggcggaggttgcagtgacccaaaatcacgccactgcaccccagcctgggtgacgagtgagactctgtctcaaaaaaaaatgttctgggtagttctcatgcacagccaaggttgagaaccactgagctaaaggaaccttgaagacacagctgctgtagaccacctcttttgccccagcttgattcattgttttcattcaaccaacatttcttggtcagttaccatgggtcagctaccactatgccaggctatagcagtgtaaagttgattaagacagattcctagtatatgaaaaccagttgggtcacgagacatttcgcagttcccctcacccgggagcacagagaagattccctcaattgagtgaccatgagacacagagccacagagcagcagtgaactggggagtcacagaagagcatctctccttgcccattcctctcccaggaagtaggtggtagaagtgggcaggggctgggggatagtggcaggtgcacagagggtgtgaaatggcagaggctggaagtgtcatgtccctgatgtaactacgtcaacttgacggtgtcagatgattgccagaggggaaagacttgccccctctgtagctcattcgtgtctcacatgtatctctctgatttgttcctttagtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacaggtaaatgtcacttgaacagcggccaatctgccaatcaagacatctatgataagaccatgttgagcctttctttgtatgatgttcgcttgatttctagagctttcctttcgggattctaacgttctaatgacttacatggttgcataagagtcattgtgttgaggtggcatatctaatttaatcaatatctaatttaatcattcctctcttctgaaaccattaagtttattctactttttagctcccaggtatcggtatctttcatgcagttgtcactttgcttcttggctgtggctgagttccattgttttgaccaagataatggagaaatagctctaaagggcaagcacagatctcatttgatggagttggagattttctaggtttctttctcctacaaaagttggttggaacactgttttcaacaccctgaagagtaaacttttgatctattaaacatagcagctcagcttagacagaagacaaaagaaaaaattggcaggtctgaaaatcagtcagtcacagagtgacagagctgggactgagccaaggtagtggtaggaggggagaaacactgtgaagacccaggcttgggtccgcacgggccctcgcagacagtgtaatctggaacaagctccttctgcctccgcctgttctatgcgaggatcaaaatcatcacactaactgcatgaggctgagaatgaaggtgtacgtgagaatgctgtggaaaccgccaaggcctccagggtccaaagtgggcttagtggtacagagataaaggcaagagggaaagaagctgagagaaatctggatacactgaagtttcagttccatgagtaagaggcaggtcttcctctagaatttggaggatgggggaggcaaagccaagtttttggtgacattagattgattttggtacccacctcctccaccctggtgccagcatcaccaggagatgaggagcttctgccaaatgacttcatatttcttcaaatttgcactgctctctcttcagtaaagttttttaaattgtttctttttttttttttttttttggtagctttggggtcttgctatgttgcctaggctggttttaaactcctgggctcaagtgatcctcccacctcaacctcccaaagcgttgggattataggtgtgaaccattgtgcccagccaataattttttataaatgtaaatattttcagccaaattagaaaagcattggggctgtagtcaaaggaaggtccaatggctgatgaagaatacagtaaaattgaagttcattagcctgggcctaagatgcccaccttcccaaagctaattcccagtgatccctagactcagcctaacaggctacacaaaacactatcaaggtggcctctggtgcctatgtattcctggggcaacaagaagcaaagtgacatattcataaaagatacagattgaggtgttacccaggagctaaaaattagaataaacgtaatggttccagaagacaggaatgattaaataagatatgctactgtaacacaatgactattatgcgaccatgtaagtcattagaacagaaacagaaatatacagaaacttgggggcattttcaagtcttgatgtgaggtgaaaatagcccaacaacaaatagtttgcacaccatgtttataacagtgtaaatacacatgcataaagatttgacgggaataggcaaaataataggatgttaagtggtgaaattaagagttgtctgttgttaaagacaggtttgtatcattgtttccctattaaaaatcagacttacaggtgatagtccagctttcataatattcttttttgttttgagagagagagagagtctcactctgtcacccaggctggagtgcagtggcgcaatttcggctcaccgcaacctctgcctcctgggttcaagcgattcttgtgcctcagcctcccgagtaactgggactacaggcacatgccaccacacgtggctaattttttaaatatttttagtagagacagggttcccccatgttggccaggctggtctagaactcctgacctcaggtgatccacctgcctcagagcctcccaaagtgctgggattacaggcgcgagccaccgtgcccagcccataatattctctttttcacaaaagagcttccagcaatccacataaaatcctgtacacatgatacaaattaaatacaagtatacttgtgcttatatgagtatatactaaatacactgatgtgctttatattttttagatttattgaagtaaaatttgcatacagtaaaatgtatccaattttatggataaatcaaatttttgcagttctgtgcagctagaaacacccacagtcacgtaaccaccatcataatcaagatacataagtttcccactactcccaaagttcccttgtgtcccttcgaagtcaaaacctaatcccctcacccccagcccctggccaccactgatctgtttccatacaggtttttggatatttctagaatatcatatgaagagactcacttagtatgtggccttctgagtttggcttctttcacttagcataatgtattggaaaactggagatccacccatgccattgtgtgtatttagagttaattcctttttattgctgaataatatttcactgtatggaggtaccatagtttgttgatccattctccagttcatggacattcgggttgtttctagtttgggactattatgaaaaaggccactataaacattcatgaacaagtcttcctaagacatatgtttgtatttatctggggcaaatacccaggagtgagtttgccatatcacagggtctatgtacgtttatctttattagtgggttttccattgtgtgttcataacacgatttggctctttgatatagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaaggtacgacttcgcaaactgaagtggtggtaagaggggaccctccaaagataaagatgctgctcacatgattaatatcaccaagtcttttactcccaagtaccaggtacatcatggtttctcaggttgctactctatattctgcttagaatgaggagacagatgggactgccaaatctacactaccaaccttgaggccagacattgtggctcatgcctataatcccaccactctgggaggctgaggtgggcggatcgcttgaggtcaggggtttgagactagcctggctaacatggtgaaaccccgtctctactaaaaatacaaagattagccaggcatggtgatgcgtgcctgtagtcccagctactcaggaggctgaggcaggagaatcacttgaacccaggaggtggaggttgcagtgagccaagatggcaccactgtactccagcctgggaggcagagtgagactctgtctcaaaaaaaaaaaaaaacaaaaacaaaaacaaggctgggcgcgatggctcacgcctgtaatcccaacattttgggaggccgaggcgtgtggatcacgaggtcaggagatcgagaccatcctggccaacatggtgaaaccccgtctctactaaaatacaaaaaattagctgggtgtggtggtgtgcatctgtagtcccagctacttgagaggctgaggtagtagaattgcttgaacccaggaggcagaggttgcagtgagccgagatcacgccactgcaccccagcctggcaacagagcgagactccgtctcaaaataaataaataaataaataataaactgccaacctttctttacagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtacatcataattgatggcagaaaaaaacattctcttgtgtgtgattgtagtccccattgtatttcatgattgaggcaattactgcttatagtcaggggtgatattcaaaatatttggcatctagaacagtgaggcaccatagaatcaagccgggtgccatggctcacacctgtaatcccagcactttgggaggccaaggcaagtggatcactggaggtcaggagttcaagaccagcctggacaacatggtgaaaccccatctctactaaaaatacaaaaattagccgggcgtggtggcatccacttgtaatcccaactactcaggaggctgaggcaggagaattgcttgaactcgggaggcagaggttgcagtgagccaagattgcaccactgcactccagcctgagcgacagagtaatattccgtctcaaaaaaaaaaaaaaagacgttggtcttggctggtacaggatgtcagaggtcccccttacaccttgcgttaaccctttagcagctgaattttggaatgtggcatgggtggtatccagcagagggttctaggcaattgggagagtaggcaggggtgtcagctacttaacatcacatttcgatattataacaagtgttagaactgcactgctgtatatagtggtgctgagtatcattcctgtttctagtgttttctgtccacctatttagagggattgggggctacaaacacccaaggaaaccaagtctcgctttttaattttcatagtcttccctttacaagtgtactgcacatggttctatgaggacttgactctaactggtcactaacttggtgtgtctgctgctacagtctccctggggtctgcagtcatcttgcacttttcaactatttctttgcatccttaaaatgtttcctttccttcttggaggcctcctctccttattacacttccttttttttctttttttttgagatggagtctcgctctgtcacccagggttgagtgcattggtgcgatcttggctcactgcagcctccgcctcccgggttcaagatactcccctgcctcagtctcccaggtagctaggattacaggcgcctgccaccacacccggctaatttttgtatttttagtagagacagggctgcgccatgttggccaggctggtcttaaactcctgacctcaggtgatcctcccgactcggcctcccaaagtgttgggattacaggtgtgagccgccgtgcccagcctatacttcctttctttaatttagtagcaaccagaggaatagaagtagaagctattttgcatagagatgccgcaggtcaggtccttacagaaccctgcgttttaattattaggctggtgcaaaagtaattgtggtttttatctttttttaaaaaaaaaatggcacatactgcaattacttttgcaccaacttaatagatgtgttttccatctcattatactagctccagacatttattcttatcttccacttgattttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgccaagcactatcctaagcagttacaaatgttaactctaatcctctcaacaaccctgagaggaaggaactattattatcccattttacagatgaagccatggaggcgcagagagacgttaagtgacttgcttggggacacacggcttaaatggcttaatgctatgttctctttaaagattcacaaaatcctgttgtgtcaatctgtgcgctttagctcagtatttagagcattgtattgtagaacaagctctgtttctctgattgtgatcccttgggaaagtcactttcctccttgtccctcgatttctgacctatattgtaagataaacaatgtggactgaatattccttagtgttccttctagctctaaaactctgacaatatctcatttacccttgccatcttgatgtgccaggatccttccctggagaacctctctctgatcagctacgtcatatcatcgagtgttgcaaacctgaccgtcaggaacttgacaagaaacgtgacagtcacattaaagcacatcaacccgagccaggtggggagaggccagtgccgtctgttcattgaccaggaacaccttgtacaaactatgcttgtaaggcatggccggcaaaaggcagatcaggcagaaagaaccttcagctcagctggagtagtttgcaggactagaatcacatctctccattggattttaacacacttaataattgaccagggcaggtgcagtggttcatgctgtcatcccagcactttgagaggctgaggcgggcagattgtctgagctcaggagtttgagaccagcctgggcaacatggcaaaaccccatctttgcaaaagatacaaaaattagctgggcgtggtggcaggctcctgtaattccagctacttggagggctgaggcgggaggatcacgagcccgggagctcaaggctgcagtgagctatgttggggccactgcattccagcttgggtgacaaagtgagaccctgtctcaaaaaaaaaaaaaaaaaaaaaaattgaccacctaatttccaggaagaattggtgcaaaagcaagctcttaacaactgtgaaatatcagatatcagtgtgtgtggatctgtggctgcaggtctgattctcagctcagttcacactaagcatcatctacgacctcactactcacagtgtggtccacagacccacagcatcagcatcacctgggagtttgctagaaatgcagagtctcaggccctaacccagacccactgagtcagaatgtgcattttcacaaggccccaaagtgattcctatgcacgattgatgagcttaagaagtgctggtctatttagggcttacttgcttctagggaccatataaaataagaactctctaaaaattaagcctaagattctgaaatttaaaaaaaaccacagttttttttcttttcaaatacctttcagttttgctttttttttttttagttcagtaaattaattatgtgtgatttatctttctaccacaggatgagttaacagtgagatgtgtattttgggacttgggcagaaatggtaagttccagtcataaccttttcaaactcttgagtgggttaattggggagggtgtgaagtcactggtgctgtggccttgctgatgggacagatgttcttcccaatgccaacaggtggcagaggaggctggtcagacaatggctgctctgtcaaagacaggagattgaatgaaaccatctgtacctgtagccatctaacaagcttcggcgttctgctggtaatatgcctgtgccacgtggccttaaattctgagtctgaggggtagctgggcatcacactacaatgtctaatctgatggatggataaccgtgacagatcagcagatatgatattgtggctgatttatacaccaatgagattgctctttgctgggcatggtggctcacgcctgtaatcccagcactttgggaggccaaggtgggtggatcacttgaggtcaggagttcgagaccagcctggccaacatggcgaaaccccgtctctactaaaaatacaaaattagctgggtgtggtggtgcgtacctgtagtcccagctactcaggaggctgaggcaggataatcgcttgatcctgggaggcagaggttgcagtaagccgaaatcacaccattgtactccagtctgggcaacagagagagacgccatctcaaaaaaaaaaaaaaaaagagagagagattcctcttctaataagcaaatgcacctgaaggaaaatacctgaacatgaaagacaagtattttttcacattctctttttacatttaagtttttctcttttaaataattaagagaactaaggaattcagattaggatgagtaataaaaattgtttagtttgcaatgcactttaagatttttacaaaacactttgacataaatgctcttatttaatcatcccaacagtcctgcaagataggtagaatggggagttgctattgtcattttattaaaatcagaattaagactctcttgttagatagttgcccacagtcatagaactaagaaatgtaagaggcaggagctaaattgcagtctttaggctcctagtccagttcctttccattgcactataatgcagtgatcaagtatgtgggctttggagtgtgccagacctgaatttgaatcttggcttctccactttctatctgtgtgtccttgagcaagttacttaacctctctgtgtctgtctctgtttccttatctttacctgatagtaataattgtgcctacctcataggtttgttgaatagactatgaatggatccctagaatacttgatacatcataagtcttgtatttatttaaaaatatttgattattaaaagcaatatttcattttccaggacctatctaggacatctgtgctgcctgctcaaatgatggctctgacgttcattacatatattggttgtgggctttcatcaatttttctgtcagtgactcttgtaacctacatagcttttgagtgagtatccacaaccggaaatttggatttaggactcagcactcacctccattgccaacatttattaactaagccctttcctcggcctgccttaccctgtacacccagctagtggagcatccatgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaatagatattcagtgagtgtagctctgcagcaagaatgccattctaaaaaacagcctttccttcttggcttaccagacaggtccctttggttgctttttgggggtaattccaacaaattctaatggaaaagaaggacatgggcatttttattgcattaacgaatcgaaacaatatgtaggttcttggatttagattttggacactgatcaggaaatgtaaaaatttattttcagtgccaaagttagggtctagctgtgactacggatcttctagtgagcctttggaaatattattagtgagactaaataaccagaaggccagccattactcagaatgatttcatcggatctaattttgcatgcataaacatgaacatgtcatcaattagctggcttctcctatgctattacatttagctgtagtttaaactcttctttccatgatctcattttacctaataacatacaataatatgggaatcttggttaaattttgaagatctgaatatagcagactccatgagaagcagcaccaatgcttccgaaagtagtctgggagaaatagggcgagtgcttagtagagtctactacaaactatttaaaagtatgcgtcaacagtcagcatgtaaaaggtcccacagaaatacagacacaaattctccttatggttatcacagatgattctgtttagatttttcctttgttgttgttggttttaagctcccccccaccccatatacacatatactcaaacagaggaaatttatgcatatagacatttaccaaagaataaaaataaattgcttaaaactcaaagagcctgacagatatgcttacataagggttggtgctaggtgtggtaactcatgcctgtaatcccaacactttgggaagccagggcagcaggattgcttgagcccaggagtttgaggccagcctaggcaacatggcgaaaccgtgtctctacaaaaaaaataagggtgtggtagagagcgcctgtagtcccagccactcaggagactgaggtgggaagatcgcttgagcccaggaggcagaggttgcagtgacctgagatcacgctactgcactccagcctgggtgacagagccagaccttatcttaaaccaaaaaaaagttggagggttggcagagtagaatgctcattcttgttctcatcctttccttttagaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggtatgtataagcttgcctgcatgttgcctggactttctctgccttttctctagtgttttgatttttgagcaggtggaaacgatgaagcagatcacattcagcaagtttctaaaacagctttatactcttacatgtgcactgcccgaagagcaactttgtcaagtctccttctaggacacctgtttatttctttggatttgttatgaatatggaattcctcaaggttgaaccatgaatcctctttgtatctccaggaactagaatttggggctggcacagaaggtgctcaatatattgaaaacattagcttggggtggtaatatattgaaaacattagcttggtggtaaagagcccaaactctcagtccctgagctcccagccagcctcattctactttgtacctcccagatatcagacacgtatgacagtatgctaagaagggcagagtgagagaatgtacatataaaacccattgtaacttcactgccacgtgggcatgacatttcagattgtgcagcctattggtggcaggtcgcaaggccttaggctccccaaatatgttgaagatttcttcattcaatttcccacccaatgcaggagcctcttcaaccctcaactccacctgacttatccttgactaaagataatctaacttctgcttgaatacttctattactggggagttcatgaccttacaaggcagccaataaccattttataaagctctacagttctgattttccattaagttcagttggctccctggtggcacttaccagtggttttgctcaggcagaaaacagtaagttgatacctcttctgccagagagtcctttagataatctacaagtaatatataacagtgtgtataatcccctgtttttcacacaagtgaccccatgcaagataagccagtgaggtgagccaggcagtcatcccaaatgtaggtgaagaaactggctccaagtgatgatgtgatatccccccaattcacaaagctagaaaacagcaagcctggctctccgtctccttatatgcagccttctgccatccccccaaccagactgcctctattttcaggctaaatattcctacacatcaagattgaaagcacaccaccacccttgccaccctgccttctatcttatgtcactatgtctttgtgaagaacaacagaacaacaccctttccctgtttgtcccagaaacataagtcaacgctccagatactgggcacggattctgtcttctttagagaaggctgaaagtcagattcctttcttaagtatgaggcccccacccccaatgttttatttttaacaaagtgtctcacttagaaaattatcatatgtcagggtcaccagaaggtacaagcgcaaaggcattaaatgaactattagatttgattttaccaggcactgcaactggtctgtgacaaggaattgtttgttctttaccagagccttgagataggacgtctgctggtcagtgtgcagagtgtggggcggtggcatggggctggcgggtgatggtgtgcagtggtgaataggattctttccccaccaaaagccattttaaacttgggggacccttctcatggtaccttctctgaagggaagtgtccgtgggctctcaacagagccagcatagtagcagtcaccaccccctggatcagccaggacagaaccctccatccttcactgggtctcaaagtcttcaaattgaggacttttggtttcataatgaaagatttgccaggagttgctgactcttaaatatacattccagacatgtataagttaaaggcacaacgctgggtgcagtggctcatgcctgtaatcccagcactttgggaggccgaggtgggcggatcacctgaggtcaggagttcgagaccagcctagccaacatggtgaaaccccgtctctactaaaaatacaaaaattagccaggtgtggtggtgcacacctgtaatcccagctacttgggaggctgaggcacaagaatcgcttgaacccgggaggcggaggcggaggttgcagtgagccgagattgtgccactgcactctagcctgggtgacagaggggggccgggtggggggtggggagttaaaggcaacactggcagctgtaacagattcaccttgaaatctcagtagaagatcatttctcactcacctacagtctagttagcaggggcagaggagtccctggtcttgcagttattcagggatccaagctattgaagactctgcctcaaggttgccctaagtttgcaggcaaaaagaaagtagaggatctcacaggaggtttctatggggcaggcctggaagtggagcaaatcacttgtgcccgtatcccatgggcccaaagtgagccatgtggccacacacacccagctgcctgggaggctgggagcatccagtcatgtgccaaagaggaaaagaaaccagcctggtgaacagctagccagtctctgctacaagatgtaaataggatgtgatctctagtcttgtcacccactttggttattagaactaggtgtgaccagccgggtgcggtggctcacgcctgcaatcccagcactttgggagaccgaggcgggcagatcacgaggtcaggagatcgagaccatcctggctaacatggtgaaaccccgtctctacgaaaaatacaaaacaaaaattagccaggcatggtggcacgcgcctgtaatcccagctactagggaggctgaggcaggagaatcacttgaacccaggaggcggaggttgcagtgagccgagatcgcaccactgcactccagcctgggtgacagagcaagaatccgtctcaaaaaaaaaaaaaaaaaaaattaggtgtgaccaatgtttcccatcttccaggggtaccagctgtggttgtgaccatcatcctgactatatccccagataactatgggcttggatcctatgggaaattccccaatggttcaccggatgacttgtgagtacaaagccccctaagggaatgctaagtgaactggaaaacggaatgctcctagaaaacggaggatctaatcagcatattgactcctgctatcatcctaataaaacccagcaatacttcacagcagccttcacagtcatatgtaatgagagaagctagctggaaatgccatgctactcttcaagtgatgaattaggagctattctgaaaagaaaaatgaattaggaagaactattttgaaaatattttcattagcctctgataaaatgacattccagttatattaataaagactcatagaacagagttgctaggatttacaggggcaaaatcctgaatgtttaaaaaaaggtctatttttaaaatactttaaatcaccaagtgtcctcaaataaactcttagattattttccctagagctataaatggttgtagagaatagcagttttatcattttttttctcttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagagatgttgggggtttggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaaaaaaaaaaaaaaaaaaaagtactatctgtgaaaccccatgaggtatgcttgtatatgcaaagtagcttatttagtggcttatgatattttcattgaaaaacatatttattattgagagggagtgctttgagatccttggaggaaaggtgcttactaaattcaagaaatggtgtttttttctccttattcatagttgtctccttggagagaccatattgaggggaacctgccaggaacactttttgaaaaagtcaattattcttccttcacttggtttcttttaaaaaaaaaaacttttgtattcaagtagaacatgcagactgtaagcacacataccatgactgtgcctgtgggagctcaccactctcccctcctaggtcagcgatttggagacaatgagaaatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgctgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctgtttctctcctaatgcaaccaatggtcgacttccagggtgacaaatgaatgaagctgtgtaatattcagacatgggtcttgacggtgggcacatataccctactagaagcaaaactgttttgtttgtttgttttttgagatggagtctcgctctgtcacccaggctggagtgcagtggagcgatctcggctcactgcaacctccgcctcccgggttcaagtgatcctcccacttcaccctcctaaagtgctgagattacaggcgtgagccaccaccacgcctggcccctggtatcttaaaatgaaggttttaaagtgaatagattgggggtttttaagtagaaagcagagaacccagaattcatccattcactcagcaaatatttattggcaaaagccttggggagtggcagccatggggctggctggggagccctggcctgccttgactgggcacctgagtgggtgagaggtggagtcccagggccccttcaggtcttcagcttgctctccatgccagcacctggggcaggtcaggaggaggcaggcaggtaggtgagtgcattgctgtactgcctgggtttgagggggagagagagatccaagcaaaggacatggcagtgggctggagaggaggagagtgggaagggaaagatgtgtggaggagatggcatttgacagagcttggaaacggattctaaatagggagggagggagaggcaggagcctaagtccaagctgggatcctgggtggatggcttgtaattccaagatacggaaggccaaggacaggatgtgggaggagacagtgaatttaattgtggaaatgcaaagttatgattccttttatcatataaatattcttaatcttacaaagattttctaaaggcattcattccccgatgccttttgacagcaagctttcctaggactctgaactttttattcaatttgcaaaatttcatgttgcccacagctgccaaaataattattaatatcttttgtgcaaagtgagcttatgacattcagctattagcttggaattcattgtgggttttttttccctccttaggatttttcatattcatcttttactgtgtggccaaagaaaatgtcaggaagcaatggaggcggtatctttgttgtggaaagttacggctggctgaaaattctggtaaagatttacctcactttttctcttcctcttaaatctcaaggaaaagattgtataaattaagatccaaagcaaatccaatctagaaatcagtgaattccagcaaatctggaatttgctcaacagaaaatattgatcgtgaacattagggagaaaaaaaaatctagtgaattaaaaaataattatttctatctgggaattttttgagcaataaaattgatgggctggctgcctcttcaatgaagcaacagtaaaatttttagaattgattttctattgagattatgcttttcatttcccaaagtaatttttaatatttaccttggtaatttttaaaatctcaactcaatcctttctccacaggtcctggttgtcagttgctttatttgttagtaagccagactttgtgtataagctttagcatacatttggttgtaacatacatttgtttattttgaagtgattttcacatatacccggttgggtagtagagcaaatagctcattttttttttttaagaaaatgagaaaaatgaagtactgtttgaaaagctacattccttttgcatgaataccacctttgcagtatctgggcgacacgggagtctgtattcagaaaatggcagtacacatagttcaatcattttcatggagtgaagaacaattagtcattacaacacagactatttgtgttcttgttaagacagtgtgaggctctgaatcactacctaattctatggatatttatagacataatcaaattagcttggcctttagttctaggagaatataggttacttttaaccccacagtcatttgaaggacaaatgtaaataatccaaatgaaaatacatgttatcacaccaactggtggaaggtgacttctccataagatcctgaagtgagaaatcagttgcttaggacttgttacactgtgatctgtctcttgcgtttgagcttcaacatactgccctgtttttctgtaatgcttattctgctgtagactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggtatgtatgtctcaatatagtatttctcaagctagtgtttattttttaaaatagttttatcctttattggcattttggctaagcaaagtgagtaactattaatacatatatgactagtggatcaaaatgtggttcccttacagaagagaaagtttactaatccaaattgatttattatagagcaaatactggaacaacgattttttaagatttggtttttcatagtgggaattgatgatgacctaaaaattttaacattttaaatcctcacttaactattgtccaaagacttcagtattgtgctatttctgtgagagcagtacctaaaatagctgataagactatagcaatttttattacatctatcataatatacatgttcaacattttttttttttgagatggagtctcactcttgttgcccaggctggagtgcaatggtgcaatctcagctcactgcaacctccacctcctgggttccagcaattctgcctcagcctcccgagtagctggaattacaggtgacctacaggtgaccgccacgatgcccagctaatttttgtatttttagtagagacaggtttcaccatgttggccaggctagtctcgagctcctgaccacaagtgatttgcccacctcggcctcccaaagtgctgggattacaggtgtgagccaccgcgcccagccaacacttttaaaccttcctattttttgcttttcatgtttgttaattctttcccacaatgtggctgtcttgtgacagcacccaaatccccatgaatatgtcaaaatactggaagatgacttgtgaccagtattggtgaccatatatgtgaccaatatctgaacagattattgctgccatgcctcctttactcattaattctgacatttctagctaaaacttctgttacattttctttctttcataagaccaggctgttcattactcataaaagcttaccttatctatttttaccttctcttgcttcttaatatatcttttgcattcttataaaaacataagctctgctggtatagtttctccttccatggagaatttgcctgtattcattgttttaggatgttagttcttttcatgactaactcaaataaatttgtgagaaggttcatacatctaccagttttcccgtttcctgaagatgggcagtcctgctggtgtgtctagacttttttttttttttttctttttttttatgacaaggtctcctattgcccaggctggagttcagtggtatgatcacggttcactgcagcctcgacctcccaggctcaagtgatcctcccacctcagccacccgagtagctgggactgtaggagcatgccaccatggctggctaatttttttttttttttaagatgcagtcttgctgtgttgtccaggttggtctcaaactcctgggctcaagtgatcctcccgcctcagcctcccaaagtgctgggattacaggtgtgagccactgtgcccggcctgtctaggcttttaaaataccataggatgcctcaaaatcaaggtttctcaacttcaagcacaattgacattttggggctggataattcttttttgtggaattgcaggacatttagcaggatccctggactctatcaactagagccagtagcaccctgcccccagttatgacaacccaaaatgtccccagacactgccaactgtcccaggggagcggggagaagaagggagcaagattgcccccagttgagaatcactgctgtaaaagatgagaaataactgttgtatagccttagctctttactgtcgataccagaaagcaagctctgggctctacaccaaatagctctatcaggaatgattcaatgtaggtaaacagaggcgaggcagcggggagcacagctggttagtacgttagtgtgagaaagcaaattgaaaggagagacatcaaaggagcgagcagggtcatctggggctctgaatccataaaccagatttgtccatattctcgaaagagctcagagatgaagcctcacctgcctagctctatcaacatgttgtcatcctttgggaaatcagatttcatggaaacagcacattttaccacagttgtttaacacagctgatttgacacagctacttttgatgcttgacggtgaggatgggggtacattttaaggctgccaaaatggctcagtgtttaatatcacataatatgcatgtcagataaccattcctgactcctcagtccttgccccagcatctgggatagatgaggaatggaattggcaatttcaaaaaagaaagctagggctgggcgcagtggctcacacctgtaatcccagcactttgggaggctaagttaggaggatcacctgaggtcaggagttcaagaccagcctggccaacatggaaaaactccatctctaataaaaaatgtgaaaatcaaccagacgtggtggcacacacctgtagtcccagctactcaggaagctgaggcaggagaatcgcttgaacccaggagacagaagttgcagtgagcctagatctcaccactgcactccagcatgggcgacagaacgagactccgtctcaacaacaacaaaaaaagctagaagtttaatgatttattatgccagaccaaattgttcttgcaccaaaatgtcctcaagccgaaatgcctaaatccaaacagctgcctcagacagtcacatgccctatttgatctgtgtcacagatggagctacgttaaccatattcatcacctagtttgcatgaatattacacagttcagttctgagctgccttagagggtggggtaccagcagccatctcatttggtacccaggaccacaaggatcacagtttggaagcaacatcacacgtcaactccattacttctgagctgtgtgaccttggggagagcacttaatttctgaaaccttcgtttcctcatctgcaaaatggggataacagtagtacccaccctgcagggctctaaatgagataataaagtgtcccagtactgttatgatcattgttatcataatcatgtcatgaactatcaaatgggcttattattcagctttgtgtatagtctcccaatggtctaatgatcagaaggatggtgccaagtaactagaggaggccagcacctgtgctcccctataactcagggcctgcttggggtggggaaggcccacgtccaaaccaacagttacccttgagtgcccagctgctccctggcctggactctgaagttggaattggtagtttcctcttgggaatttgtcctgtcctgatttagtcagaggagctggtttaatctacaagagagatgatttcttcttgccatgactgttgtagctggttgctctggtttctctggtacaaagtttcattttataggaacctagggaaccaagaacttcctaagggtacatatggggatctctgttaacattaaccttttgggagaccaaagtattaccttagcttatattatacatatgctgctacttgaagtcaaaacatatccaaccagagttaggaagtgggccttttattaatatattaccttgcttcagattttgactgtttcattaaaaaccaaacaaaaaaaaaactgccatagagaactggtttctgaagcaatctccactttggtatgcttactttgagtggccttagggaagtaatgaaaaataaataaaatatgaacatatatcacaaatgtttttaaaaacatattttacaaatacatctttaagaataaagcaatgtctaagtttgtttgctttttaatgctttctgtggatacttcatgccacccgctttgtgtttccttatacaggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaag

SEQ ID NO: 3173 - DNA, 133245 bp, human
cgggagcggcgggggcggcgccgaggccgcgggcggggggaggagggccgcagccccggagaggggaaaaggcgggccggacggcgccagcagccagccccgaggacgcgagcggcaggtaagcgctcggcgccaggacgggtctggccccttggggtcctgagacccagactcgcacagccggccacgggcgctggaggctcgggcgcagcgtctagccccggagggcggcgggccagcgggccggcgggacgaacgcgccttccgcccggctgctgttcctagccggggcccgggaacatcctgaaaggcggaggcgtagctcccagccccggggctagttccccgactgggggagcccgcgcgccgtgggaaaggaggctccaaggggagacgcgcgtctccaaaaccttcggacggagccgtactttccccaacccgcgggaaactgagccacgagcctgactcgcgcgggtggtgtgctagacgccaactcccgggagcccggctccgcgcgcctggtcgggctgcggcggtgctggcggagcgcgaacgcgcccgggccccggacggcttggggcggcaccactcggcgcggccccgaacaggtggccccgggcaccgagggacggagcggcggcccggagccagggggtgagcacgccggggaaggagggggctcgtggtctcggagtgagcgcatttcggcagggactcgagtttcgaggctccgaaacccgataaaaagtgagggggaagaagagagctgacctcccgagagccagacgaagcaggggacaggttttccgtggctgcttcgacagtgacagtctgtactgtgcacgataatcccccagggatcccgttaaaatgagattctgatcccgcaggtctggggtgggggccgagcgtctgcatttctaagaagctcccagtggctgctgatgctgttccatggaccacactttatccggcaggccctacggaagtactttttgtccagcaggctgaaaaccttaggaaaagtgggagattgggagacgaggtcctaagactttacagtatgtatagctttaatacctctttgccacctctacccccaaacgcacgcaaaaacacttgctactataaaggccaagggaaactttcccttcgccccctgaaggttcgcttgaaaaattaactgacaaagacagattgattggagaaaaggcatgcaaatgtattaatgtgtccacggggagagaacaatagagtgattacccccagccccccaatggggtacagaagcatgtagattatcttgaggttacagaaagaaaggggtctcaacgcatggccccaaacaggttatggtggtaaaagaggttgtgagagggggagaagaggaggcttggccagcaaaaatggtctggagatgtcaatgaaacctcacaggtggcagccctcagagagaataaacagtaaatgtttctttcagacctttaaaggggtcagatcctcagttaatttctcttagatctggacaagggaggacctcgataaagcctggctacatccgtgcagattctctacaaatgcaaatcttccgcaccaaggacagctttgcattagctctactggctggctttctaaatacgtcaatatttagaaatatgtcaactatttcaaaatatgtcaaagaaatatattttggggtaaaatgatttgatttccttcactactcatttaatagcgaaatattttacttttcttaccaactttctagccaaatacatgatctgatagcagggctggcttcatggacatgcatcctgcacttggtttaatgctgaaattcttaatttttgaacaaggggcctctccttttcattttgcactgggtcccacaaattatgtagctgatcctaatagtcaccatacgtggaaagagaacccattttttgatcagggtttgagatggtgggtgatggagagtagaggtttattaagggaagactagctagatgttgcagttatctccaatctttctcaactcctctttggctatctgaagagataagtctaagagcatacccaggcatgcatggtgtgacaaaatttattactttattaatatcaacagttaacagtttattaggagcttaattattgatagacaatacaattaagtttgatattgaaataattttgtaagtttattgacaagttgtgtgttattttcaaaggattggggagtctctatttagcatctcataaaattttgcttagttaagatctaagatgagctggacattgcttggtttggcagctttcacagctcaaatgcaaagctggaaaacaaaaagtggccaaattttgtagcttttcaggagtattcttttacagggcctcagcgtgatgccagcccggatcggattcccttctgcttttatcactcccacatctctgcaaggtgactttcattaaaagggggatagagcatatttagctactgaaaaacactgaagaaaggcagggccagcatcagtattttgtctgtgaagaaatcttgcccaaaaaacacagattccaggtgtgtgtatttttctagaaaaaagaaatgttggaaatacagaaaagaaaaagattgtactctaactatggatatgattttgttcagcagagggagaaaaagtcagataagtggcatttcattggcgggtttggcagggaaaggaaagctgctgtgtttttggtaccatgaacagccttccagaaatggcaaagtgagtttgctcaggtgcaaggaagagccagcaaagaagctgattttccatggctgatgtgatcattgtggggactcagagcaggacatcacgacatatgttcttggtgctttgacggctcagatgaaactgaaaaacacatttttccacttttctgcctgagcgtgccaagtcgctttcaaatacacgatccaaactgggaagagtgctattaaattaacaaaaggagggagagggaggtgtttctgtgatgtccatgattcaaaagatagaaaggagggattctgactttagttaaaacctgggagctagtttttatgcttcactgagaaaggttttcctgaccacaagataggaagaaaaaagttcttttaaaatgtttatggtttcaaaaatgtgtaggtatttaatccgcatggaatttattttgggattgtggtgtgaggtggtgggtgatggaacttaaacgggctaacatttggggaaagctatcataaaataaattcccgcaatcaaataaattgtggtaaacactgtcccattttacaaatcgatttaatggattcttcagtctactccatgtttttcaaattgaagtgtaacttattacagtaaaattcactcttttcagtgtacagttctagaagttttgacaaatgtatatagtcatgtaaccaccaccgtatcaggatgtagaagaattctaccactccaaggaattccctgttgactctttgtagtcagcctcccccaactctcagcccctggcaaccactgatttgtttgctgtccctataattttgttcttttcagaatgtcctgtaaaagaacttatgtattctgtaggcttctgagcctggcttctttcacctagcataatgcatttgaggtttatctatgttgcacggatcaatacttcattccttactgttgctgagcagtatcccaaagtttgtttatccactcaccaactattgatgattatgaataaagccaatataaatattcacatatggctttttggatgaatgtaaacttttatttcactcaggtaaacacgtagaagatggctatgttgtatgtgagctttatcaaaaactgataaccgggcacagtggctcgtgcctggattcccagctactcaggaggctaaggtgggaggatcgcttgaggccaggggttcaagaacagcctgggcaacatagcaacattcccgtccctacaaaaaaaattaaaaaattatctgggcatggtagcatgcacctgtagtccttgctactcaggaggctgaggcagacggatctcttcagccggggattttgaggctgcagtgagctatgattgggccactgcactccagcctaggcaataagagtgaaactctgtctcaaaaaagaaaaacaaaaacaaaaagaaattgtatccttttttcccacttcattttctatggtagtgagtaggaaggctatttaattgtttttctgtacatttatcttacattcaagccattttactgaacttttcttagttctaatagtttttcagttgattttcttggattttcaaagtagacagtcaaattgtctgcaaatggcaataatatagggaattttccctccaatatttttacctcattttattttcttgctttagtggctaggcttccctgtaggataatgttgagtagtagttgctactattttaccattaactattgtgcttgccatagggttctggtggctaccttaattatcctcaggatgtttcttttccattgttagcttgctaaaagtctaaaagtttaattttaaaatttcttgttctgcttggaattctttttttttttttcccattgaaagcctaagaggtttaggatcagttagtttgcttcttgactttggaagttcatattttgatctcactggaggagaagttagtgtagcattaagtcaattcattttattttattttatttagatagagtcctgctctgtcaactaggctggagagcagtggtagtaatctcggctcactgcaacctccgcctcctgggttcaggtgattctcctgcctcagcctcctgagtagctgggactatggcggcgcaccaccacacctggctaatttttgtatttttagtagagacggggttttgccatattggccaggctggtctcgaactcctgacctcaagtgatctacccggctcggcctcccaaagtgctgagattacaggcatgagccactgcgcctggtaattcattttatttagatgatgaagaacctacctttggaggtttttttaataatgttcttatttgggggaatgctgggtgtactgaggaagaaagagaatcaagagacagtttataacctactcatgtataaacaaggtagctttttctagtgttcaaactttttttgcccaccattcacaataagtacattttatatttctttttttctttcttttttttaattttttaatttttttttttgagacagagtctcactctgttgcccaggctggagtgcagtggcgcaatctcagctcactgcagcctctgcctcccaggttcaagcagttctctgcctcagcctcccgagtagctgagattgcaggtgcccgccaccacacccgactaattttttttttgtatttttagtagagacgaggtttcaccatcttggccaggttggtcttgaactcctgacctcatgatccacccgcctcggtctcccaaagtgttgggattacgggcgtgagccatcacgcctggccacattttatatttcagctcagtccaaacatacttgtatataatggaaacaaactctcacaaagtctttgtctttctcctgtgtgcaatgtattgatattttcaattatctttcatctgttctatttcattttaaactgatgatcatgattttccaaattgatttgactaccctttcatttgattttttgacccacagtttgaaaaacattgttttgtaaaactgctcatttagtttctaagtccccaaactgctggattatgtccagaaccgattcattttatatcagatcctgctatgatgcaaagtaagttcatttattatgctctgagatcagtgtaactacctatttctctcttgaattactgtgtagcctctaaaccagtctttcagtgtctacttttgaccccacagaatagccaatacatgcagtcttataagtccatgactcaaactcctctaatgacctcttcccacactttttttttttttttttttttttttgagacggaatctctgttgctgaggctggactgcagtggcgcgatcttggctcactgtaacctctgtctcatgggttcaagaaattctcctgcctcagcctccctagtagctgggactacagtttcacacctccatgcctggctaatttttatatttttagtagagtcggggttttaccatattgatcaggcttttctcgagctcttgacctcagttgatccacccacctcggcctcctatagtgctgggattacaggcatgagccactgcgcccggactttttttttctcttgagacaggatctcgttcttttgcccagactggagtgcagtgtcatgatcatggctcactgcagcctcaaccttcggtgcttaagcgatcctcccacctcaacctcctgagcagctggaggcactacaggcttgccccaccatgcctggctaatttttaaaaagtttttgtagtgacggggtctccctgtgttgcccaggctggtctcgaactcctggattcaagcaggcttcctgcctcagtctcccaaagtgctgagactacaagcatgagccactgcacccggcctgcacttttttttttcttagacgagatggggtctcagtctgtagcccaggctggagtgcagtggtgtgatcatagctcactgcagccgcaaactcctgggctcatgcaaccacacccagctaatttttgtatttttagtagggatagggtttcaccgtgttggccagtctgttgaactcctagcctcaagtgatcctcctgcctcggcctcccaaagtgctgggattataggcgggagccaccgcgccgcctcctaccacacttacaatcaatccctagggcctcactggtacctcctttactccctattctcaacttctccaaacacagcctcctccgtgcttatgttcctcacccaagccaagcgtttgctgtgctacctgcccagaacaccatttcaccagatagtttctttgtttcatctgagtcttctctaaccctcattctaaaaccgtactccccacttaccacaggaagggtccattcccttatcccacttttgttttctttatatcactgttacctgcaattatgttatttagttatttgtttactgatgctgcgtcttcttttccttcctggaatataagttccaggaaggcagggactttgtgtagtttgctcatcattgtgttgtcaggacttagaacagtgggacgtagtaggtgctttatccacgtgtcaaatgaccgaatgaatgagcctagaatatagataaaatctgacacttgtcctaagagaagtataatgtgccctgcctttctgttccaatgttagtgtggaaatttctttaggttaagcgtggagtattttaatgtaagcagttcattaaccaatacacactcacctggtatccactatatttctgacactctcgtaataataatgatagctaatatttactgagcagttactacccttattgctttacatctattaactcatttaatcctcccaacctcttgaagcaggtacaattctcatcattttacagatgaggaaactgaggtacagagaagttaagttacttgtctaaggtcatacagaaggtaagcagtaggtccggggtttgaatacagaccatctgatttcagagcctgtgttcttcatcacaagctcctagctagagcaaggagtgcgcacaattcctgacctttgtaagcctgtcacgtttatggcttagcatagtggttctcaactggaggtgatttttgcctcccaggggacatttgacaatgtcaagagacatttttagttgtcatgactggcagggtttggaggtgctactggcgcctagtggggagaggtcgaggatgctggtaaacatcctacagtgcacagcacagcaccctcaccccaacaaacagtgatccggcccaagcattaatagtgccaaggttgagaaaccctgccgtggcacagtggttctgaaagcccgctgcccactggaatcactgggggagcttgataaatcaataccgatgtccaggtcttgttcctgaccttaataaacctcaaatggaccttcaacatggcctgcagtcctaccatgcttgcctagtgggtttgtttttccattctccaaaacagttgtttgacaccttttatttcctctgcccctcctagatcagttgctgattctggctcattcaacaggagcctcctcataacccactacctggacccccaacaggcccatatttgtgcaaataaagtgttccccagtgccactgtgaagctgtgactgaaatgcccctaatggatcaaaaactggctgcttttctgggctctgggtccctcatcctctttgtcttctcagggactttttttttttttacttttttttttttttttttgagacagattcttgccccgtcgcccaggctggagtgcagtggtgcaatctcggctcactgcaacctctgcctcccgggttcaggtgattctcctgcctcagcctcctgagtagctgggaccacaggtgcccatcaccacgcctggctatttttctttgtattttcagtagagatggggttgcgccatgctggccaggttggtctcgaattcctggcctccggtgatccgcctgcctcagtctcccaaagtgctgggattacaggcgtgagccaccgcacccggccttaacgttttatttggaaataattttaaactttacaaatgagctgaacattttttttaaaaagtacaaagaacaccccatgcccttaatccagattcctctgttgttagcattttatcctgtttgctttatcatttacactcttgctcgtgtacctaggattttcctgaaccatttgaagataaatttcatgcagcaagaactttaactcctaaatccttcagtagggatttcctaagtataagaatattctctcaaataatcacagcgctgttatcaatctcagtaaatgttttgataagatactgttatctaatctgccgtttgtattccaattttgacaatagacctgataacatcctttacagcatttttttccttctagtacaggatccagtttagggttgttgcattgattgattgattgattgagataggctggagtgcggtggcacaatctcggctcactgcaacctctgcctcccaggttcaagtgattctcctgcctcagcttcccgagtagctgggactacaggcacgtaccaccactcccagctaatttttgtatttttagtagacatggggttttgccatgttggccaggctggtctcaaactcctgacctcaggtgatctgcccgcctcagcctctcaaagtgctgagattacaggcgtgagccaccgcaccggcaggtttagagttgttgcatctagttgtcatgtctcttagtctcttttagtctggaacacttctattgcctttctttgtcctttgtaacgttgattttttttttttttttggttttttttttgttgttgttgttttgtgtttgagacagagtctcaccctgtcgccaggctggagtgcagtggcgcgatctcggctcactgcaacctccatctcccgggttcaagcaattcttctgcctcaaccacccgagtagctgggattacaggcacaagccaccacacccagctaatttttgtatttttagtagagacggggttttaccatgttggccaggatggtctcgatctcttgacctcgtgatccacctgccttggcctcccaaagtgctgagtgctgggattacagacaggtgtgagccaccttacccggccttttttttttttttttaatagaacattaatcatgtctggtttgtctgatgtctcttgtgattggactcaggttatgcatttttagcctgaacactgcgtggatgacattatatccttctcagggtatcttattttggaggctcataatgtccatctcttcctcattggtgatgttaattttgatcacttggccagggcattgtctaatttctccactgtgtagttattggtttttctttccaaatccacagtctgtgggaagacacaaatatcctgctcaaaatttccctctagggccaggtgtggtggctcacgcctgtaatcccagtactttgggaggcttacttggaggatcagttgagcccaggagttccagaccagcctgggcaacatagtaagaccccgtctctacaaagaaaattaaaaaattagccaggcatggtggtatgtgccagtggccccagctacttgggaggctgaggtattaggatcacttgaacccaggagatcgaggttgcaatgaaccattatcggaccactgcactccagcctgggtgacagagcaagaccctgtctgaaaataataataataataataataattccctttagatttagcatccagtgatgatttttgtatgatctattctttaatatggttgaaaataataattttcgactctagtattccctccacatttggtccagagcccttccttctcccctatttattgattgattcatctatttatttttggtatcaaataattcatattttcaaaataggtctgcaattcattactatacttaattattttagtgcacaaattgtaaaggacttaattatgcattgtttccttctctcttttctgcctaatgaactcctctctccctgttctagatcattcccatcagcttacaatcctgctctaatgtctaatatcttcatcaattccatattctcctccactcattccccacccccatttctagtcactccttctcagaagatcttcttaaaaggatgctcatattttatcacaccacattgtcagtcctcagtatatccacattggcaaatacagccatcacttctttacttaccatgttttacttggcggcagcatttgacagtcattccctccttctttgaccactttcttgttgtggcctccagtatcctacgctctcttggttttcctatctttctggtagctcattctaagtctcctcatcctctcttctacctatgaaggttgatgtccctccaaggcactgggaactgttcttctctttctacctactctcctgggatgagcccattcattcctatggctttccattccatctagatgccagtatctccagttgtgacctttcctacacttaagacttaataatttgcatgaatctctaagaggcatctcaaactcaatattttccaaagcaaaatcctgattccctgtcaccctcatgcaaaacctgattctctccctgtgaaatccatctcagtccatgacatcaccattcactccatcgttcaggctccacacctactagtttcatgccccacatccaacccatcaacaaatcttgtcaatttggcttctaaaccgtatcccaagtcttcccacttctctctactcctactattccactatacttccatccttctccgtctctttcttggatgattgtagtggcctcctagaatccaatatccacatggcagctagagtatcttcttaaaagcattagttggattgtgtcattccctactggactatggaagtctgccatgttctagtccctgcccctcttctatctctcttgctgactgtgcttctttattgattcttccagcacattaacctcattttagtcttttatactaactgttctgcctggaatgttctttctgtcctctactttatcttctgtttttttgttttttttttttgtttgttttttgtttttttttgagatagagtctctccctgtcacctaggttggagtgcagtggcgcaatcttggctcactgcgacccctgtctcccgggttcaagtgattcttgtgcctcagcctcctgagtagctgggattataggtgcatgcaaccacacccggctaatttttgtatttttagtagagaagatggggttttgccatgttggccaggctggtctcaaactcctggcctcaagggatccacccgcctcagcctcccaaagtgctgggattacaggcatgagccaccgcgcctggtccctcctttatcttcttattgctggttcctcatcattcagatctcagtttaaatatctcctctttgatgacctgatccaaaatagccaccaggttaccttctatatcatctcaccttactctaattctcaatgctgtatttattatctgttaatttccttgttgatttgtacatttattgttctcttctcctccttccaccctcctcacactagaatgtgagcagggtccacatctttacccccagtgcctagaatagtatttggcatgtagtattcaattttggtgtttaataaatatttgatgaataaatgatacatttaatccttcatgcatgattctcagcacatggaagatactcactaaatgtcctcttgttgtctttccccaagagtacattcttgtgtctggggctagtctagaagtttccagtgaagacaatcatctgataaagagattcatatttctgtgttaggatcctgattattagggtttctagacaaaggggaattacattttaccaagaaaaaaacagtgatagaattccagggatcattagtgtcacatttttcagtgtgggactttcctggccctcctaactacaagactggttctcagattccacaaaatcgacatgttttatcttgggattctgtcgtgtaaatttttgaaacacttcatttgggaggatcacgtggatttttaggtgggaagaaggggatagcaaaggaagtggcattcttctctgcctttgttaatagtatcatttcctgtgcccatttcaacgttagctctggtataacacaagtgataagccgtgtgtgttattgaaatctgagaaaagggcaccaaaaaatgtttagtactttgtactggtctaaaattcatgacttgaatatgtggggagagagtgaggaagattgggaagatgtatactgaagtggtttccctttgaggtattatttgaagattggtgtgatttttgggaaagctcttgtagtggattttaaagcttccaggaaaaaatctgtaccaatgaacacgactaatgattttgtcagcagatgattcgctttttgacagaaatataccacatgtttttggggtatttggagaaaccatcacccttgacccagtaggatttttttttaaactgggccaaatgcttattgtattcacagttcatacatgagtcaagagctgggcgccattactcagcttgtgatattgatcacctgttcatcacgattcatcatttcaagcagccatccttatgaaagcaggcaagtgtgtcaagtagtatttcatggacatatttagagcgttcttcttcttccttcttctttcttcttcttcttcttttttgagatggggtctccctatattgcccaggctggtcttgaactcctgggctcaagtgatccttctgcctcagcctgagtgttactctctttgacttatccataaaagtggatccaatgtgtctacatatattttttaaattaaacttttattgaagtacaaattatacacattacaaatgtacagctcaatgaattttcacaaactgtgcatatccctgtcaccagcccccagatcaagaatcccacacaagcagcctttagaagccctcctcttgcctcctttcactcactgccccccaagggtgactactgttctccctcaaatgccacatattgtgcctgttcttaaatttcctatatgtggtaccagacaggctacctgacttctgctcagtattgtttgtgaatttcctccatatcgttgcatgtggttatagttgggtgattgtcactgccgaataatattccgttgcatgattaccatggtttatcctttctactgctgatggcctttgtttggtttccagcagttttggcttttatgagtggtgctgtgggtgattctcttgcctatcttgtagtgaacatatatgtgcattactaccaggtaaatacctaaaagaatgctttaaatagattattaatagtttttatggttactgtcaattattttctcctctgaatgcaattaggattagtagccacctttggacataactcacacatctgtatccatagacaatgatgagactttctttctgtaactttttttttttcttgaactcctcaagcaacctgcccgcctcagcttcctaaactgctgggattacaggcatgagccaccgcacctggctttctgtaactttttttattaagttctagcattagttgtttttacactttaattttcttttttctttttttttttttttttgagacggagtctcactgtcacccaggctggagtgctggagtgcagtggcgcgatctcggctcactgcaaccttgtgtcacctcccggagcgattctcctacctcagcctcctgagtagctgggactacaggtgcgtgccaccacacctggctaattttttgtatttttagtagagactgggtttcaccgtgttagccaggatggtctcgatctcctgactttgtgatccgcccgcctcagcctcccaaagtgctgggattacagacgtgagccaccgcgcccagcctatactttaatttttttctaataattggtttctatgctgattttttcctttaccaactacctatatcatatcatcattttaaaatatcttaagaattttagcttgctttttcttttcctgcctgcccccaccatccccacccccagctgtatttcttttgaaatgaaaaaaaaaaaaaaaacaaaaaacaaaactcctggaactgctgaatgtgttttgcagatatagaggtaaaggtttaccacccgaatagctttagaatggtacaggcttattcagcactgattcctagtcttgccaaggaaaagtaaaaaggacaaagaaaggaagaaagaaggagggttaaaaaactaaattatgctttattttgtggtgtattggttgacagtagtatttttctctgtctcctctcagctaatctggtcatttgaccaactggatagagcaaatattgtctgaaatgaagcaaatacattccatttgattttggtgggagacaaatttttaggcagggaaaacgattagcagatagtgtcatgcacagcagtgcctttcaaatgccaacatgcaaaacgattgcctggggatcttgttaaaatgcatatgcggattcagcaggtttgggactggccagagatttctgcattgcagctcctaggtgaggtgatgctgctgttggggcgggggagctgcactttgagtagcgaagctttagaacatagctgcctccatgttcctggggattatatggagcatttgcccgttgcccactgatggatgataaacagctctcccaagtacccctctgggcttgtcctctcagcactgccggcagaaccaggttgtgtgtagcctgcattaaagcagcagacaaagcccagggctcttcttttttttttgagacagagtctcactctgtcacccaggctggagtgcagtggcatgatctcggctcactgcaacctccacctcccgggttcaagtgattctcatgcctcagcctcccgagtagctgggattgtaggtgcccgccaccaccgcccagctaatttttgtatttttagtagagacggggtttcaccatgttgcccaggctggtctcgaactcctggcctcaagcgatctgcccacctcggcctcccaaagtgctgggattacaggcgtgagccactgcacccagccgcagtgctctttttttaacctggaatagcaacttctttcaaatctccctcacctggactctcctcaaatatctcataacacctgaagaaaaaccactaacctcaaacacacgccaaaccgaaacacacacacacacacacacaaacacacactatcccagatactgacatggagaaaggagtggggtggggcaggcattaagccactcttttttctcctggcttcactatcgcacacttcctcattcattccagagcaactaggtgtctgtttcaacatccctggccccaccattatagtacacaccagtcaccttccagccacgagctgcacatttctctgtgggggccctctttacacatccatgctgcaggttggaagtgccagggaattaacagctcccaccccaccccaggagcagccttcaaccaatgcctgatgcaagtcagtggatccataccctcaagtgggataattcagaccggtgttctacactggctcccagaattccccagaaggactaaactcccattgcccccagtggtgactggcttgataacgccatctattggctgccttcctgccccaactcacgtgtccattctatctgtgtttcctggggtcacagcccagataaactacttatctcgaatatgtgccaaagagttaccttcttcttcttcttctttttttttttttttttttttttgagacagagtctcgctctgtcgcttagactggagtgcagtggtgcgatcttggctcactgcaacctccgcctcccaggttcaagtgattctcccaacccagtagctggaattacaggtgcacgccaccatgctaatttttgtatttttagtagagacggggtatttcagctaatttttgtatttaaaaaaattttttttattatactttaagttctggggtacatgtgcagaacgtgcaggtttgttacataggtatacacgtgccgtggtggtttgctgcacccatcaactcatcacctacattaggtatttcttctagtgcttttcctcccctagccgcccatccccctacaggcccccgtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgcaaaggcctatttaacatggcctaaatagcaactaattatagttggatgattgtcactgccaaataatattccactgcatgactaccatggtttatcctttctactgctgatggccttgtgtataatttgtactacaataaaagtttaatttaaaaaatatacatagacacattggatccactttcatggatgagtcaaagagaataacactcaggctgaggcagaaggattgcttgagcccaggagttcaagaccagcctaggcaatatgggaagactccatctcgaagaagcagcagcagcagaaaaagaaagaaggaagaagaaatacaaaacacataatttttgtatttttagtagagacggggtttcactatgttggccaggctggtctcgaactcctggcctcaagcaatctgcctacttcggcctcctaatgtgctgggattacaggcatgagccaccacgcccagccttggagttactttttttttttttttttttttttttgagacagagtctcgctctatcacctagacgagagtgcagtggtgtgatcttggctcactgcaacctccacctctcgggttcaagcgattctgctccctcagcctcccaagtagctgggactacaggcacccgccaccacccccagctaatttttgtatttttagtagagacggggtttcaccatgttgaccaggctggtcttcaactcctggcctcactcaagtgatccacccaccttggtctcccaaaatgttgggattacaggcatgagccaccacacccagcagagttaccttctgaaggaacccaactaaggcaaaactggtcaacagtcaggaattccttttgttaattttaataaaatcctattataaaaaaagggggagccccatggggtttcttctgaggggcatctcaccagtatctagatattttgtctgcgtgacaccaaacagtcagatggctggaaataagcctgataatggagagaatgcttctctgttcccgggctgttttgggatctggtcaacagagttgattttctggacaccccagtcaagctagttcaggtctttttgacctgtacccagagggtgtatctctgagttctgcctcagaagcttgatcacatcccgggggctcctacaaaccacatcctggctgcagccaactcccttccacaggcctccctcactgagtttctctgtggtgggttctctgcatagcctcttgggatgaggagtccttctcagacctttacagaacagagcccctgacactcagtttcaagggcctacctacatccgtttccgaagctttgcatcgatggtcactgctcctcttagccatgtcctcagctttctcctcctcctgccttcttccccagactgaagtggatctgaaccttggcacaatctatgcctcttagtgcattttaggggattttagggctgcctgggcccctctatatgttcagacgtgtgataggacccagccttttcccctcaagaccttgtatttgaaattccccattctatggtttgtctcatctttggaacccacagcaggcagagatgtttgggagggtggcctcactgggcacactgtcctggatgtctcacagttttgcatacctctgccaggctgtgctgcccccaggccagactcctgtttctctgtttgggcatcttgggggtcctaattagacacttagtcctttggatttggtattttgagagtacacgtggtatcaacagggctagctttaatgttaaaacatctattaaaacaataagggtggatggctaggtgactgctactgttactaaaagaggtcccgatccagaccccaaaagagggttcttggacctcatacaagaaagaattaggagcaagtccatagagtaaagtgaaatcaagtttattaagaaagtaaaggaataaagaatgtttgctccgtaggcagagcagtggcatgggctgctcgactgagaatacttagagttatttcttgattatatgctaaacaagaggtggattattcgtgagttttctgggatggggcagggaattcccggaactgagagttcctcccctttttacactgtaaagggtaacttcctgatgttgccatggcatttgtaaaccgtcatggcgctggtgggagtgtttttagcatgctaatgcattataattagcgtataatgagcagtgaggacaaccagaggtcatttttgtcgtcatcttggtttttggtgcattttggctggcctctttaccgcatcctgttttatcagcagggtctttgtgacctgtatcttgtgccgacctcctgtctcatcctgtgactaagaatgcctaacctcctgtgaatgcagcccaacaggtctcagccttattttacccagtccctattcaagatggagtcactctggctcaaatgcctctgacactaccctgtaactttcttagtcaacttgggctgccagaacaaaataccatagattgagtggtctaaacaacagaaatttatttctcttaattctggaggccgagaagtccaagatcaagatgctggcatggtcaggttctggtgagttccctcttctgggtttatagacagctgccttctcactgtgtcctcagttggcagagagaggtgggggaagcggggagggagagggagagggagagacaggttaccctgggggttagggcttcaaaatatgaatttggcaggagggacacacaagtccacagcaataactgtgcatgactccacccccatctccccacccccaccagtatctcatctgttgatctggctgaaatctgaaattccacaattagagattcatttccttggtttaaagtgttataatttaaatgagcacagaacctggtcgatgggcctccatgcgaggccttctcctgagagccagtgaaaaagtatgaggtcactgggcacctacaagttgggaatggcccccacctagaagacacaaagagtactaaagaggaaattgattttcttcaagtgaggtgggcttgttaactttgccaaggcctgtcctagtcctcagagttatgttcatatcagttcctgcaaaataccccttaaaataagagaaatgagtccttcatcttgcttttttgcatctatgagtgatgtgaaagacattgccttttaaagagggagtccaggccgggcgtggtggctcacacctgtaatcccagcactttggtcttgaactcctgggctcaagtgatctgcctgccttggcctcccaaagtgctgggattacaggtgtgagccaccacacccggcaatattttcaccgcaatacttcatcttcctcccctactaacatccaaatggtacctgaagtaaagcgagccacttcttatggcttgttattgctgggaacagctgcttgtggataattagctcaggcaatcagaacactgggtcaggaaatcaggcacgtgggtctgactcctgtatggcctttgctcttggggacctgttgagggtgggtcactgctggttcagtatgtgctgcatgtggaattccatcccctttgaacctgtaccattaatggggtaacagctggaggtgcttaactttggccctgcatcagttttcaaaagtgcataaaggtaagcactatcctgaaactgttgtttatctttctcatacatttctttttttttttgagattgcgtctcactctatggcccaggctggagtgcagtagctccatcccagctcactgcagccttggcctcctaggctcaaatgatcctcccatctcagcctcccaagtagctgagactacaggtgcacaccactagggtcggctaatttttgtattttttgtagagaaagagtttcaccatgttgcccagactggtctcgaactcctagactcaagtgattcgcccacctcggcctcccaaagtgctgggattacaggcgtgagccaccgtgcctggctatccttctaatacatttctttatattttcctacataggaatatgtccttaagcaagagagaatgctactcgcatgccttttaagctttataagattggtgtgttttttactttcacattttgcaactttcatctcatttaatactatttttgtgagattgattctcttggctacatgtagctctagctcatttttcttcctttgctttatccacaaaccactcccagagaacaactgaactcacagttgccagggtgggggaagagcaggaattacacacacacacacacacacacacacacacacacacacacacaatctcatgattagttgatttgaaacacacctcaagctattctcataactaaatcttaatccaaccaataattcctttagattttaaccacttaactttggaaattgttttataaagctctagttcttccatatgttcacaactcacaaaattggttttgcaaataatccttttaccctttgcccgcgaggaatcgcaaagctgagtttgctttcatttgccatcgcttttcttcccgttttcagatgtcgttatctttctgtttccttttttacttggcatagatttgccttcctttcccaatagtatgtccaactctttcaaaacctctccattcattcagccatgcattcttttcacatatgtttataacatccctagtatgtgccaggcacttttgcaggcactggggactcaacagtaaaccaagcagacaaaacttctgccttcggcaaagaagcttatcttccagtgagtgaagcagacggtatttgagtaaaatacacggtcagttagatggtgttaggtggtgtctgtggaggaaaatgaatcttgggaaagaggcacaggaagccgtgaggggttgcaattttatatagcatttttctaggccaggggttggcaaaccatggcccaaggccctccatctgtttctgtaaatgaaggtttattggaacagagtcacgctcattcacttacatgttttccatggctgcttttgcattgcaacagcagagttcagtcattgcaatggagaccattttggctgcaaagcctaaaatagttcatatttggccttttacagaaaatatttactatttgaccctttgcagaggaaatgcagatttttacctatgataacttttgaggattctacccatgttgtgcttttcagcttctaaagcgttgtcaggaacacgatgtcatctgagtgttgaagtagtgtttgttatgaggtaggtctcagtagctttgttttacaggtgactcaactgaggcttgaaggggttattatggttgtccagggttgctgaccttgtaaagtggtcgtgttttttggtgtttttttgagacagggtcttgctctgttgtccaggctggatgcagtggcatgatcatggctcactgcagcctcaacctcctgggctcaagtgatcctcccacctcagcctcccaagtagctggaaccacaggcatacacaaccatgcccagctaatttttgaattttttgtagagatggggtttctctatgttgcccaggctggtctcaaatccctgggttcaagggatcctttcagctcaggctcccaaaatgttgggattacaggcatcagccactgtgcctggcctaatgctggtgttcaactctaaaagctggtgcgttttctactttccagtgacaaatacaacccaggtttttagcgtgacgagcttctaagcacatgaaacacagataggcaatcacgtgtaggtgtcacgaatgtgggctcagaagctcagcagcccaagttcaaatgcttgttctgccacttacctttgtgacatcaggcaagttatttaacctctctgtgccctgcctcagtttccttgtctgtaaagcagtcataattgtatgccttctaggtcaggtggtgctgtatcttggttttgccaaggcagctctgatttatgcctgttttttccacattaatcaatagtgccccattttactctcacatacccccatttggacattaaattatgtgcatgccctaaccagggtcgttgcagagattaagtgagttaatacaaataaagcaagttaatacaaataaagcagttcaatccatgctgtaggaagcatttgctagactttggctgttgtttcttgtcaaggccatgccagcccatcacttaatttttttttttttaacttttttagatggagtctcgctctatcgcccaggctggagtgcagtggcgcgatctcagctcactgcaacctccacctcctgggttcaagcagttctcctgccttaccctccagagaagctgggattacaggcgcctgctaccacgcctggctaatttttgtattttagtagagatggggtttcaccatgttagccaggctggtctcgaactcctgacctcaagtgatctacctgccttggcctcccaaagtgctgggattataggcatgagctactgtacctggcctcacttaattttcttctgacccattgctttgtcccattaagtctgaactgatttctgtctggagcaattttgcttatctgggttaataggtgattgaggattcatcttctgtgtggcagtgccttctggctcactccctgacctcccttagcagctttgctcagatgtcatcttctcatgatggtgtcacaggacacctctctaaaattgctacctcccccacctccaacacacttcatatccacttctctgctttatgtgtttgctttatagttattactaacatacaggttttactgagctactactgatgtggttctgttttgctgttacttggataaaaaaaaaatcctacaaaatctgctatgcctgtgagaatatttatttttatgttttaaaaaaatgtatctttatcattacattttcagaaattacagaaaaacccagtaaaaaattcagcccacccatggtcccccctccagttggcattttgctgtgtatcaagaatacagcaattttaccccacctctagagggagtacattttctaatctaaccatataactttagctaaacagcttacaagcaaatgacagtttactatgttctctaagtattattttgattcctttaaaaggagatttttcctacacattttcatctgaagctggcctaggaggaaatataaacacactggtctagcctagtcccatctctagaagtaaaggaaaaaaaaaacatagaagagaaattgagtgaaaaggcatgttccctcacttgcagttagctttctggcacggtggcaaagcattggcctggcgcctgccaaaatgagcatcttaatagaaattatcatgtgtgacattcctttgaattgctaactttctttgtaatattgagcaagttgctttttgcatcattgatataattcatcttcttatgtgtttgctttatagctctctttaaaactgtcagtgtttcacagattgatccatttgcgtttttatttgtttgaatgccgcactggcacgtacaacccaaaagggcacagttgtgtgtgtcttgttcaccactgcactcctagcacctcccgtagtgcctagcacatggtatttacttaataaatatttgttgaatgggaaggtgcctgagcacagcagagtacgctcaccctcgatgcagtgagggtgtcctgccaccggggccggggtggggaggagatgacccagtataaggtcctcagctgcgagagaatgaacctccaaaatgtggtcttggtccctcaaatagcattcacactttctcccccaggccccggattcctgtaacaaaggataagtcattaattcagtcctccgagttggtttaaagaacagatgcctttgttttttttgagacggagtctcaccctgttgctcaggctaaagtgcagtggcgctatctcggttcacttcaacctccacctcccggattgaagcgattctcctgcctcagcctccccagtagctgggattacaggcacctgctaccacgcctggctaatttttgtattttagtagagatggggttttgccatgttggccaggctggtctcgaactcctgacctcaagtgatccacccgccttggcctcccaaagtgctgagattacaggcgtaagccacaacgcctggccaaagaagagataccttttgagagaggaagctcaataggaccttcacacgaagaggtcaggtgtgatattagctccattcctgggacagctgtgatcaagtgggagcggaaagaagagcataaggaggggaggcagagaggggctgggtggagtggcatggccaaggaggaaaacatgcaggaagggcagcaggcccatgccagacctcttctcttctagaaaagcacatgaagtgtcagccacagagatgtatgtggagcaatttgcagagtgcctggtgcccggaagcagttaacgatggcactaacactcacagctaatatttttgagcatgtgctctaagccaaagtctgctaagcactttccctgtactgactgactcattactcataagaattttaggacataaataagaagtttatccccatttgatgggtaaagaatcccaggtatggaggcagtaaatatcagcaactactttatcccatgacttgtgataggctacaattaaacactggctgttatcatcatgactcactgaaaatacctcaccacctccctacacctcccttttttctgtaatagtgaaaaggctttgacaatgttgtcaataatgtggcattagtactataggataaccaaaagcagcttgtaatatttatggcaagggagttttaaaagatcttttgagatattgtacacttgttcttacttgcatgagcacattacatttttatccaggcagaatcatttttctatcaaatggtagttttcaacctattgctaactgcaatactgattttttttttttttttttttagatagagtctcgctctgtcacccaggctggagtacagtggcgcaatcttggctcactgcagcctccacctcctgggttcaagcaattctccctgcctcagcctctcaagtacctgggattacaggcacatgctaccatgcctggctaatttttttatttttggtagagacagggtttcaccatgttggccaggctggtctcaaactcctgacctcaggtgatccgcctgactcagcctcccaaagtgttgggattacaggcgtgagccaccgcacctggcctggtccatttccttttaaccctgcctttccaatgagaacctgggagatgattaaaatattccattttatatgtacactgcactttaaaaatttttttaatttaattttttgagacaagggctccctctgttgcccaggctggagtgcagtggcacagtctttgttcactgcagcctcaacctcctggactcaagcaatcctcccatctcagcctcccaagtagctggggctactggcacatgcccccacacccagctaatttctgtattttttattgagatgggggagggtctcactatgttgcccaggctggactccaactcctggactcgagtgatcctcccaccttggcctcccaaagtgctgggataacaggtgtgagccattgcgcctggctccccggcactgtttttactataaaatttttcagctgtccccgagactagattatgtgattactttattttggatgagagaattgatgtttactttttcctcagcattctatttatcattctaattaacaagttaccagtttcactaataaaatgcttttggcatttgatatgctgattagcgaagtgtggattgtaggtcaaggtcacaatggcagaaggacgtgtaggagctgccttgagagagtggcctttgtgctataaagtttgcagagcactcatcgagttcaagcttaaactcaccggcacacacaaacatcacactgccttccctgcggtatattaaagtgagttccagacctcataacaggcaggcccggggcacctcatggttcatggaggctttggggtacagtggcaagtgattagctttgggagtaacatgactcatgtagtctcccgttttctcaaattatctggtgagttagtctcttactgcaagggaaaaaataatactcccacaccacttggaacaccccagttttgggaaaatcactcaaaaaatgctgcttagccacccatgcagcatccgtgctgctggagggtcatttgggaaaaggcagcgtccagacgcctgcgggaggcaggatttttatgggctgtttttgtgtccagtttcgtagttttcagaggagtccattcaggctgtcaatgggaaccgttgaacctgtcaagttgctgtttgccgggtctcttggaaaaacacactgcaacatcccagccctgggcgggtcagagaggatagtactaaaaaaagaaggagaaagtggacggccccgctctggtgggaggccagggcttggggctgcagccaagttccctggtgatagaggagtttccaccatccaaggcttcccgttctggctccctccaccctaccgtacaccatccagccttccaaaataactccgcttccggtggaaccgggcagagtcactggaatgcgtggtaagcagaaggagcaggtagagttgatgctgggagagaaagtgttttgatgagcaaggaaagaaagtcgaacaggaaggccagccagccactgcaagactttcctggcagtaggaacactgatgggaatggcactgacttccagtttctgaggcgcagcccagcaaacccatcaaggtaggcaaagcccttccttgggagtcatccccatacctcctcctcctctctctcccagttaacagcaggccttcccatcccaatgtgcgtgcgttgtccatgcctgacctcactgggctctgcctggtcactgaggcctgctgtatccctgttcaccacccaaactgacctgatcattaaaaaaaaaatagatttaggaggtacaattgcagctttgttacatgaaggtattgtgtattggtgaagtctgggctttgagtgtaaccatcaccaggatagtgtacattatagccgttaggtaatttctcacccctcacctacctctcaccctccctgctttctatccatactgtatgtccatctatccatactctgtgtccatctatccatactctatgtctatccatactctatatccatctatccacactctatgttgatctatccatactctatgtccatgtcacattatttacctcccaattataagtaagaacatgcagtatttggctttctgtttctgagttaagataatggcctccagtttcatccatgttgctgcaaaggacatgatttcattctttttcatggctgggtagtattccatggggtgtgtgtgtgtgtgtgtgtgtgtgtgtgtgtgtgtatacctacataccacatttatgtccaccattgatagacacttaggttgattccatatctttgctattgtgaatagtctgacttgataaattaagtcacacgtgcccattagtgaccacagtcattgaaatttgcatgttttattgggtgcaagcccttaccaaaaaaacaaccaaacaaaaacagaaacaagccttgagaggtggtctcttagatactagtcaaaaattaaaaacaacttttggggtggaggaggagtcctactctagtgaagtcttaatagactctaggtcaccgtcatcttcagattctctggtatagaacatgtttacatgctccctgcccgccatctccccaaacacacaaaagatagaatcagtcactcccatctttgtgtcctcaaagcagtgttcttatgaccatgagcacgttttctcccactgttcatccacgcataggagtgaacatgtgagtttcttgccttctcagaacgttcccctttatcctctccttgtgcacacagactggcctccatttagaagaggggctcagtcaagggccacaacttcctgcagactgtgggatctaccattcaagactgctgagaggaggagtaacctgagatctgagaattgtgccaaggtggaagttatgaccttgataagaataacacaaaagcccgattgaaatcagttcaggagacgctgggaagaggaagtggaggtgctgagtgtggccaaaccctgagcaggttagttgaggactagctaagaggaaaagcttggccttctctaaggattgtcatgttttctcttgttcatggatgagatttcagaataaaacacgatccccttttctatttgggcaccaaagagccatgtttgtagtttgttaatataaaggtgaaggccttgtgacctacttacctacttcctaacttcccagtttccctccttggtcctgatctccttctgtaatttatattctccttgatcctgcctttctttgcagggagtgaggaggggaatacaaagtgccgttttgtcatctgtggtcttggttgttaattgcctgttagccttcacagaacaagtgcaactgaaggctctaagacacaagtcaacgtgaaggtcctcctccatctcgccagacaactcctggactaggtcctggttcaggatgggtttgtgcagttgctgcagacagaggcaaggactgaattttaagatgctgggtgaggagggtgaggctggagggtaagagcaggtaaaaagggactgtgcataccccacttggagctgcaggactgctttccctctcttgctgggccaggctatggccttcccctgcagcttgggaagttactgtcctcgcacctgcccgtttgggtttcctctccccctcctgcctttgaccctgctcctcatcctctccagacacctgactccaagctcatctttctaaagctgctctgtctggttaatttcaccccctcccccaattttattctcgcccccatcaagttaggcattgactgtctactctgctaatttgttgtcattgatacctgacttattttcaagttgttgcaggggaactgatgtgagggaaaaagctggaaggtgttgttaactctgtagaaattgtatgtgactatgaaggccaaaagcatttcgagaaagcatcccatacacttgtaacctagcagcagtgggatgctgggatgctgcaagggctgggatcaaaggctgtggattgggctggcagagggccggtggctgtggtgggaaggcacaccagacccaaggggtggacaagttgtcagatgacctggattctagttcacatgcagctgcttcactgcgtttgatcctcacttgccttagctgaactctaggcagtgcctgccactctttcactctttatatccaacccagacccaagtcgcgtcaattcttcctcccaaatactgctcagtatgtccatcattcatcaccaccaccaccatcttcatccagccttgtttctcacctcgaataccgtaattacttcctcgttggtagagagcagggcaaactagcgcccacaggccaaatcccacaagctgcctgtgtttataaataaagctttattagcacacagccacactcattcatttacagattgcctgtggctgtttttgtgctgtaatggcagagttgagtaattgcaacagaaatcctgcagcctgcaaagctggaaatatttactatcttacccttgcagaaaagatctgcaggcccctggtgtagaggaaaatcatttgtataattattctgactcttcttttctgaactctaatacccattacattttaatagattttcgtgtgtgtgtgtgtgtgtgtgtgtgtgtgtgtgtgtgtgtgtgtgacataaaatctgtagtctccatttcttgattctaactcttactttgtatttttgttttactgaattgctcagaccttcagaacaatgtttgagaatggagagctaaaattccaaactggacccccacttccactaagaccccctcctattcattttccatgcaaaaattgctagaacaatcttgtcaaaatgtgaatctgaacacgctgcccactgtttaaaatccttcagtgactttccatggctctcaaagcaagggtgcaaatccttaccttggccaccaagcccccttgggagctgagccttttctgtctctccagcctcatctttcactgtcctctccttgccacggcatgtcctgtccactcctacctttcttcagttccttacatgagtgacattccctcttgccacagtgcctttgcacatattacttcctctacttgatacggtctttccttgcctctttggtgggcaagttcctctcacccttccagtttcagcatcacttccacagggaagccttccccagtcccttaggtcagatccccctgtcttcacccagagctcctgttgcattgctttgtggcacttgctgtaatcgcaatatcgcacttcttggtgtgaatttttgtatcatatctctgtttccccattagaatatgaacacttacccaacctcaacatctaatttgacctttctaaacattaacatcataaccacaaacaaataggttctgggacactaaggaaaaatcaacttttaaaaagtgcaaaaaaaaaatacatcattcaggagaaaaaaataagttagagtgagaataaagaataaattagaaatgtggaagaggaaagacaagcattttaagaaatgaccttctggcttctgagttgtactgagtggcttgatgtcattagcaagatgaacgtattgattttctcttatttgtatagtaaacaaatggaaatttaagcattttaccactcacagtacattgtttcctgtagttataaatatattttcttctttcttagcctgcgcagccacgtgagggagggggtcttaaaccatgcctcttaacccttgggcatctggctcgaaggcccattttcttctcctctctgctggctaggagcaatgggtagaagggagggctagaacacacttaacaggtcacagtgacaaatatttctttcagggagattatcatgagcaaatgcccagaaacgggctgcaaactctgcccagtgtccccagaaacatcttggttcatctctttatgagtagggcccatggaccatgcaaggtctgcagaatctgcttatgtgggttccagagggagtgtatagagggagtgtataaaagaaaatgaggcaggctttgaattagaatcagcccaggccagcattttatacataatgggcccttcccttaaattggtacttgtagtacttacagaaggaaaagaagaaaggaagatgagtggagagaaataatgaaaggaagaaagggtaaagaggaagggaagaaagaaggtgtataagttagttttttccacataacaaaacagcccaaaatttagcagcttaaagcaacaaccatttaattagttcacattttttgagtccacagtcttggcagggctcagcaagatggttcttctgctggtctcggttgggctcactcatgcatctgttgtcacctgccagtctaccagatgaccctttgcctgggggttggccagctcttggttggagcaatgcctgaccaggcgtgggtctttcatcatctggccaactagctcaggctggtttccactcttacatggtggcttgagccttaaagagcagcaagagagagcaaattccatgctcaagcacttttcacacttttggttgtatcacatttgctgcattcaaggggtggagcattcaaggggtagagcaacaaaatcacattgcatggattttgcaatgtaattttggataggcaaaatagataggcaaactagaataggaaaagtttggtttttattttatttttatttaacttttattttaagttcaagtatacatgtgcaggtttgttatatgggtaaacttgtgtcatgggggtttgttgtgcatattatttcatcacccaggtattaagcctagaacccactagttatttttcctgatcctctccctcctcccaccctccaccctaggaagagtttatgagtagctttgcaatcagccacaaaagggaggggctagaaacttctcttgctggcaaagttggcagagatacagcaattttgaggtggagtttgaggtcttcatattgaatttttaaaatgttattaataaatcactaaattcctatcttccacagtttttctgtcaaatagggctagataataatgtaacttcttaatcatttccagtgagaataataacaactttatgggcaagggtttcctcatcttttatttcctggagttaaggtttagtacatctcacgtggcagatatatatggaaacaggaaaattttaatgcaccagccttaatttgtagcccaagtgtccaatatacaacaaaggcttactaaacaaaggaaacatttatgtgtgtggttttcttactacttggtgagacccatcctacatgaacaattgctctttccttatctgtgtagcttttggtcgtattttctctcatcattgaaaatacaatatcaggccaggtgtggtggctcacacctgtaatctcaggactttgggaggcagaggcagaaggattgcttgaccccaggagttggagaccagcctgggcaacatagtgaaacccatcaagtagctgggtgtggtggcatgtgtctgtagtcccagctactcaggaggctgaggtgacagcatcacttgagcctgggatattgagtctgcagtaattgcgccactgcacttcagcctgagcaacagaggagacccagtctcaaagaaaaaacaaataaacaaacaaaaaacaaaaaagaaaagaaaatatcaaaagaaaatatcaaaacatagtttaaacagagggaaatggccagtgtttgttgctacccagtggaaagagaagttgagttaattagaaaatgttagtcatcttaattgagattgatttaagttgtgatgatccaaattcaattatcctgtgaagtgttttcatattaatggaagaaagctcactctggtgaactttgtgtgaatatagcttaatgtcagacttgcatttaaaaaatcaagtatataagtgttctttttgtgaaatagtaaattaatgtttttgtaaaagaattggtaaattcttgcctatgcatttgtgaaagtgagaattgtttatagtctaaggaaggttatgtcctgttttggaatgccttagttctgtcatcttgggtagagagttggtggttgcctcacccagaccactgggactggaggtctgggagtcatttgaaggtgaggctctcaccatgtggtctttgatactctcttctccagctctgggcagaggtgaccagcaacattctagcccccggaatacacgtggcaagccttaagctagggaagggaagggaaggaaaacggggacactgtagggtgaaagagagtagaagagaaaagagggagagaagactggagggaagggaagagagaaaagaaagcttctcgtgctgcaggaaaataaagcatggtagcaacggctgcaagaggcccactgacgacttctcctggctgcttccttccacctcagcatgcagcccctccagactgatgaccaggggtcatcttttgagatgttttacaaagcaattccgaaagctctgttagtcacttgtacaatttaacaaggatggacaccaggacactgtctttccactttaaactctttggctgtgccttggtttcagccatttcctctctttggaatgctctcgcccatgtcttcatataaagggagttgcaccctttaagctgcagcctgatgattacttcctagatgagattttcctggatccatttccccacactgggttaggtgtccttcctcggtgctcccattactgcccacagctgatgccaaagcctggcattctggattcaggctcgctggtgcccttggccgtgagcctttgtgcagggcacaacctgcacaaccgtacagagcagccttgttttttggcacatagtaggcacccagttaaatgtttgttgaatgaatgatctttagttttccagaaccatctcacaatttaactcctcttgagtggtggcattcagaactgaacaaaccagtctgtgaaggtcagggtcctattaggcagggtctgatcagtactggggccaccacaaggttctagaaccactcttgtttgttcctcgatggcaatacctaccactctaagaccaagaatgtgcatatgcccaaccttctcctgcatataactttgccttccccatcatctccatttgggcaatttgtttttcctcccagtgtgaagaaactcctctttccttctctctggccccatcccgatgtatcaagacctctttgtcctctggtcatttcttccatggtgtcggtgtcagtgtcattgccaggaacttcgagccagtctgtgcctgtcggtctaggtcactaatgaatcattaggttcctaatgaagtgctgagccctccaggatgctgtatgtcatggttctgttttggttggttttggtttttttggttggtccttccttggagggcagtgggacaactgcctggggctgctgttacctgtgctccttcccaagtgggttgcagattatccctaggatgtgtgggtgctgtggccaggtgcccaggatgggagttctgactcttggacgcagcctccctgtgagcggccctgaactggagcagggctcttaagtacacccggaggtcatttccttcccacccaaaccacttgtaaagtctgcctgccttttttaaaatttatttttttgggtcacgctggtattaccctgggttttagccagcttgataaatagaggaagttgggtggcttcccagcctccctgatgtcatggtttggggcaatctgcaactgtgggaggtttcatgaatcctagcaagtggtgagtttgctgttcttctctgcgaaatttctctgttccgtgccatgtcttacataagttgatatggttccttttgtgacttgccctttcccttcaatgatgtaagaaccccaaacattggtagtcactatgttttgtcactgaagcgctggtgctcatcagatcctcattcctgttccgcttctctaggagataaaggctggtgggtgtgtggtggccacaggggcaaggagggatctgtggactgaaggatgggcctttctttaatgaagttgaggccttggtattcatcaggcatttttgcatcattgcttttgccattattttccacaacttgctgaagtgagttcctgctccctggctgggaagctggtttcttggccctgaaaccagaagtctttgtgttcccagttgggcctttctaactgaggtagagcaggcgaaggggagatgacgttgagctgagcaagtgatggctttccgtcccattccccacccactgagcttgatggaggagctctgttcagccctccttctgcttttcttcactagaagaaatctacttaattgtgtaagtactatgtaaagacatgcctgtggtctatggagtagcaatttggcttcatcctttccctcatcacactcctgggttactggtgggtttccttccaggctattttgtatgcatccacccttgtcactgtattaataaggataggccatgtgcagtggctcacatatgtaatctcagcactttgggtggtcaaggcgggaggattgcttgagtccaggagtttgagaccagcctgggcaacatggtgagaccccatctctacaaaaaactaacaaattagccgagcatggttgcacgtgactgtagtcttagctacccaggagactgaggtgggaggatcacttgaacccaggagtgggaggctgcagtgagctgtgatcgagccactgcacttcagcctgggcgacaaggcaagaccccatttctaattaaaaaataagcatacacatataactttgattgcatcttaacaagtcctcgtatatatattattcagaaacttggttttttctcttgccttatatgcattgacagtctctgtatgttaatacacctaaatgaacttcacttttaagtgttgcataatattccaaaacacagatgtgccattgtttaactcttcatctactaatggaaacttaggctccccccaccacacacacagctgcaatgacagtatttgtgtgtatatttttgtatctatgggtcagtatttctgtggggacaatctctggaattcaaatttctgtatcaaaaagcatgcacatttaaaattttaaaacatagctaaattactctctcaaagtttatgtttccaccaatggtgtatgcaggtgtttatttccccacatgctctccagctttggatattactaggcttttcaattttttcatccactgggaaaaacaaatgtcatgttgcttgccctacttttctacctgtaagtattccaagggagcgaacagagcctcctgttgttcattaataaactggattcccaagaaccattaagtgtgctttattatggtcatcagtaaggttttggaagaggtagtgtgcttgggttgggaaatttcatcaaaatatcagaaatccctatgtggaaaattctcattttcacaaatgttaaatgaacttctttcgatactcaagtcacaatagatttctttctttctttgattattgaaatgtttttcagttgttaatcctacatttagtccacattcagcattgggacatgtgttcgcaattgttcatcgtaggacaggacaacatggttggccttcatttttgtcttttatttcaagttctggggtacatgtgcaggatgtgcaggtttgttacacaggtaaatgtgtgccatggtgatttgctatacctatcaacccatcacctaggtattaagcccagcatgcattagctattcttcctgattctctacccaccccctccccgacaggccccagtgtatgttgttcccctccatgtgtctgtgtgttcacatggacacacttataagtgtgtcaccttccacttataagtgagaatatgtggtgtttggttttctgttcctgcattagtttgctgaagataatggcttccagctccatccatgtccctgcaaaggacatgatctcattcctttttatggctgcatagtcttccatggtgtatatgtgccacattttctttatccagtctatcattgatgggcatttaggttgattccatgtctttgctattgtgaatagtgctgcaatgaacatatgtgtgcatgtatctttataataaaatgatttctattcctttgggtatatacccagtaatgggattgctgggcactgaactgctattataacagtctgtcagtaggtcagttggttccaggatgaccttagagatcgtttcttatcacagatcttcatttgaaagtcattatgtcctatttcacatgagaagatgccattacgtgaagtgactgtcatcttcaagctaatagctggaccaatgttttggttcagaagtaaggcatgttggaatattctaaaagatacaagtcaggtcgtcagcaatgctctctgccttgggtggataccccattctttccccagcgtgcatctgagttttccctcatatcattgcaaatacccccatgttcccctttcaactctgagccaaacttagtaattaaccaagagttagccctttagtggagaaacaattctgcctctggcacaagagacctaaatgccccaatccttgatatcaaggagtttaggttctagggaagtgaagtcacaaacacatgaagaaatgtctaaccaagcagggtctctagaagggaccaccccaccccaggtctggtccaatcacttcgttgtccagtgccctatgatgttgttaatgaagtcttcaactgaacagtaattcatgccacaaaaacattaacaaggctgggtgtggtggctcacacctataatcccagcactttgggaggctgaggtgggcagatcacctgaagtcaggagtttgagaccagcctggccaacatggtgaaaccctgtctctactgaaaatacaaaaaaaaaaaaaaaaaaaaattagccgggtgtggtagcgtgtgcctgtaataccagctgctcaggaggctgaggccagagaattgcttgaacctgggaggtagaggctgcagtgagccgagatcatgccactgcactccagcctgggtgacagagtgagactccgtctcaaaacaaaacaaaacaaaacaaaacacattaacaagatcagtccccaaactggctttgggcttgtgcttccagtttatatataagttcctcagcagcagggtttacatccattttttctgtaactccactgccaagttcaagctgtgacgtgcagtagggagcccagggggcgtcggctgatgagctcactgcagtattgaagtattatgctgtcaagaaagtccactttccattggtctaattttgctttttattttttatttttcattttcaggtgtgcacagaggttctccactttgttttctgaactcgcggtcaggtgagtaatgctatttctatgagataatgttgtagaaatgaggaacatgttagcttgggtttttttttctttcctattttccctccttcattgcaaattcccatccccataccaactttattcttttttgtttgttttgttttgtttttaactcctcactcccacttggagctctcttttcttcagatactttcttttccttggggattctattgttgacctgtttcttcttgctaacccaattgcttttgaatgggcgttcagaaatgggtaccgattttgaagttacatggtgcggtcaaagctggggaaagagaatgatcatttacgtggaattatttgggattctgtttcactgttttcccctttcctgctccctggacgtgtgtcccttggctctaacagcttttgtcatgttttgtaatggaccaaggaagtgtttgttctctctctgacctaagtgctgtgcaaatgcagctgtcaaaggatccttccaaccagatttctgcccatgaccctcttctagatagaaattctgaagccgctactttcacgcttcctatttctttcttttttcttttcttttctttctttctttcttttctttttttttttttttttttttttttgagacagggtctccctctgtcacccaggtaggagcgcagtggcgcagtcacagctcactgcagttttgacctcccaggctcaagtgatcctcccacctcagcctcctgagtaactgggaccacaggtgcatgcaaccatgcctggctaattttttattttttgtagagacgggatctccctatgctgccagacgggtctcaaactcctggcctcaatccatcctcctgcttcagcctcccaaagtgctgggattacaggcctgagccactgtacccagcctatttcttttgagactcataaatagtggtatttctgggaattcattgacataaattatcaaaattttgtaaacaatgtaaatgtctatcataatgaatacaaattagaatgatcccattataacttacatgataaataacacattgttattataatagatactagtaagttattgctataaataaggttataacagctgagcagggtcacacagccagtaaatggcccagctgggacctgaagcaggaattggcatggtgtgatgacaaaaccaaggaagggcacagaatcctggcgaggggtgggccctggtgggtgaggcggggttggtttcctgagtccctcacttcctctccagcatggtttcctagatgaccgccaaccatgtgcttttgccctatccctgccccagccctgcagtgcagatcaatgccccaggaggcttttaagaagagcctcttatttctctcctctacatattgatagaattattttgcagcagtagattctggaccaaatcaatgaaaaaatctttgtcgagtgcctgctgtgggtgtgggggtgaggtggagatcaagcctatataggagaggctattgtgttctgcttccttgtttttgtttttaggcaaagtcgagtctgatggaccatgaagagaaagtatcttttgtttgttgttttaaaaaaaatcactattgatttggccatgccaatgaccaatgaatctgagtagtggctattaagctatcgagggcaggaaagatatctgccttgttttttgtggtatctcaagtccctggcatagaatcttgcttgtaatagaacttcaataaacattcgtcaactagatgaatgaatgtcaattattttggaaataattccaaaatctgtttacagtttgtactggagtgtattataaacttatcttctttagctgagtatggtggcgtgtgcctatagtcccagctactcaggagcctgaggcaggaggatcgcttgagcctgggaggtggaggttgcagcaagccgagattgtaccactgcactccagcctgggtgacagagcaagaccctgtcacaaaaaaacaagcaaacaacagcaacaaccaaaaaacaataaaagaaacccaaaaacttgtcttctaattatgcttgtaatcatagctaacacttcttgactacactaagactttcattacattacctcatttaatccccacagaaccctgtgaaataggtcttagcattacttccacgtcttcagatgaagaatttaaactccagagaggttaaggaacagcccaagtttacactataagtggtggagcttagatgtgaaggcagacagatggctctaccatgcatgctcccgaatcctatgctattctgctcattattgtgtgttaaacatactgcaagcattgggggcagaccctgaagaatgaggggagagagatgaagtaggctttcaccttgcgttggataattcacacatggctaatcaagagtatggtagatcgcaggtatgagagagtggagaaatctggagatgagcaagggagccaaaaaacagaacacccctcagccgggcgcggtggctcacgtctagaatcccagcactttgggaggccgaggcgggtgggtcatctgaggtcaggagttcgagaccagcctggccaactgggtgaaaccctgtctctactaaaaatacaaaaattagccaggtgtggtggcaggcgcctgtaatcccagctactcaggaggctgaggcagaagaattgcttgaaccgggaggtggaggttgcggtgagccgagatcacgccattgcattccagcctgggtgacaagagcaaaactccgtctcaaaaaaaaaaaaacaaaaaccaaaccagacaaaaagcagaacacccctcaccaggtttggtgagtgtatgtttacattaagcgcacaatttagttctaatcttgcacgtctgatattgattcacttgttttattgaataaagcttcctttttctgcatcagaaagcacttaccgcttattaagaaaatcatttttgcactgtaaagaccaaatcatttccttccatttgattctagagatgtgtaagtttcacactgcaatgatgccatatggctcagcattggctttactttgtgctctgacaaacaacatacaaggctgctgttttagagttcctattcagcacttaccagttaacctagtttctgtcatctttaggacatggttgtttttggcatatgggatgttgtttctcttactacggtaatactggctttagttcttggtgaccttatcttcaaaaaattttgttgctgaagttcagaatagttccttttgtccaatatttattcaaactacctcaatttacaagatttgaaattgcttctagacatttctgtgagcattttggagaaatctgaaaacagtctcatttgatttatataatgggcaaaaatctaaggactttccttgtctggttttggcatcggggttatgatagccttgtaaaagtgagttcagatgtgctctttttcttgagtttctgtgcgattgaaactcttattccttaaatatttgatagaatcatcagtgaagccatctgggcctggagttttctttgtgggacaagttttgagacttttaatggttatacctactattcatgtttaccatttccacttgattccttcttggtaattggtatttttttctagaaatttgtccctttctatctagagtttcaaaattattgaagacagtttttgctaagagccttttatatttattatgtttatagcatttacaggtgtgttgctttttccgtacctcttattagctacttcctcactccctgcctctctctttttctcccctttttccctcccctccctctgtctcttgattttgccagaattgtcttttcaaagagcaacgttggctttgttaatctttatgtcttttttctgtttttattatatgcttttttttttattaccttccttcttcttctttgggtttattttgctgtactttttcacacttcttaagaaccttaattcattaattttaagcctttctctttttctaatttgtatgtttaaaatataattttcactctatctttagctgtatcctatgtgttttatatacagtgtttttcttattgatcaagtcgaatattttcttttttcttttatcttttttgtttttgagacaaggtcttgctctgttgcccaggctgcagtgcattggcgtgatcatggttcactacagcctctacctccttgcctcaagcgatcctcttgcctcagactcccatgcagctgggaccataggcgcataccaccatgcccggctaatttttttatttttttgtagagatggagggggggtcccactttgttgcccaggctgggctcgaactcctgggctcaggtaacccttctgccttggcctcccaaagtgctgggattacaggtgtgagccaccacgcctggcgaatattttctaataaacattgtgacttctttgacccatgggttatttgttaaataacacatctaactttttgttattacaccttaattgtgttgtggtcaaagaacatgctgcttttctgttttccaattgtttaaaaagcttttgagacttttctgttggtctggatggttttcacagacattccatgtgctcttgaaaagattatgcgcgctgcagttgttgaatgggggcttctagatatggtcctcatgttgttggttaaatgtgtgattcaaatattctatatccttaatgactttcttatttaatttttaccaattgctgatagagatctctcattatgattgtggatttgttctatttctccttatattctgtcaatgctgtttggtgtattttgaggctatagtagttgcattcacatgtaaatttcttcagtcttcaattcagaattgaatcttttatgaatgaacggttttatttctaggtaaagtattttgctttaaagtataatttgtctgatattagtataaacacattaattttcttttgattagtgtgggcatagcatatcttttccatctctttactttcaaactttctgaatcattaggttctatttgtgtccttgtaaatagcatataattggagtttgtatttttttcagtctgataatctttgccttttaatggaatcattgagtccatttatatttcatgaatcattgatctgcttttttttttttttttttgaaatagagtttcactcttgttgcccaggctggagtgtagtggcgcaatctcggctcactgcaacctctgcctcctgggttctagcgattctcctgcctcagcctcccaagtagcctgggattacaggcacctgacaccatacctggctaatttttttttttttttttttttttttttttagtagagacagagtttcatcatgttgatcaggctggtctcaaattcctgacctcaggtgatccacccgcttcggcctcccgaagtgttgggattacaggcgtgagccactgcaccggcctgcatttgtttttaaatctttattactttctatttttcctaaccattctttgttgctgtttctcctctttcttgccttttttcagactgactgaatatgttagaaactgttttcctcctccactagttaggaagttatatgtcccatttctgttgtttagttactaaagatattacaacctgttgtagaaattacaacatgtctactcaacttttcaatgtgtaaagataatcaatacctttagcttcctctagtataatccaaggaccttgaaagactttaatttttgaatttcattttgtcatctccttacttatattacatataatgcatatattgtctcctatgtttatatatatgaggtagttgccatatgtttttattttatcatgtttcactaatccctacaagatgttattgttttatatagtagttttgttttgtttcaagacacagtctccttctatcacccaggctggagtccagtggcacgatcttggctcactgcaacctccacctcccgggttcaagcaattctcctgcctcagcctcccaagaagctagggttacaggtgccagccaccacatctggctaatttttgtatttttagtaaagatggggtttcaccatgttggccaggctggtcttgaactcctgacctcaagtgatctgcccatctcggcctcccaaagtgctgggattacaggcgtgagccaccatgactggcactgttttatatagtaaaagttcatttggatttgccagtagagagtactacccctagttctgggcacctggggcctctggcctgtgacttgtgatttagagtcccctctctggcccttctctagctccacccttctccaaatggcaagaagtctgtggcaccaagaagtcatgcctacccggagctacctccctcttcccctcacccttgcttctagatcgtactctgggaatccgggaccctggaattcccaatccaaacattctgtgccaatttccaggacctgggcactccccttcctcattgcaagccatgctgcaggtgtacgtacccccagacccaagggatgaccaaggggtacatgcatgcaggagagggggttaggggtatgcaggctgtggtgatcacatgagtgtgcacaaagcctcttacagcttggaatgaagccttaggggaagaataagggcaaagccttcttttaaactcttgatctgtatcttagaaatgttagccatgggcctggccacaaacccaccactttctttgttcctcattcctcctttcatctcagttcttatgtcttttgcctaaatacatgttttaggattgatttcagtaatgatttgcaggtagggaacaacatcacagtttctgtttgtctgaaaatatcttcatcttgccctcattcttcaaagatattttccctgagagcagaattctaagttggcagtttgtttctggcacactgcagatagacttccactggttctggcttccattgttgcttctgagaagatagctgtcagtctaacagcagcttcttaacagcctttttctttctttctttcttttttttttttttttttttttgaggcgaagtcttgctctgttgcccaggctggagtgcagtagtgtgatctcagctcactgcaacctctgcctcccaggttcaagcgattctcctgcctcagcctccagagttgctgggattacaggtgggcgccaccacacctggctaatctatatatttttggtagagacgggggttccgcctcgttaggcaggctgacctcgaactcctggcctcaagtgatccatccgcctcggcctcccaaagtgctgggattacaggcatgagccactgcatgcccagcctaacagctgctcctttgaaggttatctgtcttgtatttctgacaatttttcagatgttcctgtttttgtttttgtttttttttttcattttcactatgatgtatctaggtgtagatctctttttatttcttttgattgagattctttgggctccttaaatctgaggattggtgtttttcacccatttggagacacttagtcattatcattccaaacactgattctctctttgaattttgtttaaatgtatgttagacattgtatttcttttctccatgtctctgaacttttctttcatatgtcatatttgaaactcaggtttgcctcattaggcccatacccacaggtataagtgggcttcattgcttacattacttacctgggttcctgcttgagtttcacctttggcctggcaattcctttctatctggccagctctttgatatgtttaagaaaatgcgcagctgggcatggtggctcacgcctataatcccagcactttgggaggccgagccgggtggatcaactgaggtcaggagttcgagactagcctggccaacatggtgaaaccccatctctactaaaaatagaaaaaattagccgggtgtggtggcaggcgcctgtaatcctagctactcaggaggctgagacaggagaatcgcttgaacctgggaggcggaggttgcagtgagccgagatcatgccactgctctccagcttgggagacagagcgagactccgcctcaaacaaacaaaaaaaaaaaaaaaaagaagaagaagaagaagaaagaaaatgcgctgggtgcggtggctcactcctgtaatcccagcactttgggaggctgaggcccaggagtttgagaccaggagttcaataccagcctaggcaacatggtaaaacttcatctctacaaaaaataaaaaaattagccaggcatggtggtacatgcctgtagtctcagctactcaggaggctgaggcaggaggatcaattgagcccacgaggttgaggctgcagtgaaccgtggtcatgccactgcactccagcctgggtgacagaatgagaccctgtctcaaaaaataaataattaataataataagaaaatgcttttagcattttattcatgatttttaattgtcttcagcccaaggtttgatctaactaacctaacccaacatattcccggaacactgaagacattttttttttccctgagatatttcctgtatcgaagtcattgagcagtgttcaaatagaaatttaattatgcttttcttaccagtttcctgattctttttctgacttctttgagaattgaacaatccaaatcaactgctttttcactttttgttctcactttatccacactgagaacccctgcagtccttctctttttacatttccccttgtggtggtcttgtaagccaacatatatgactccgtataaatgtctcaaaagcatagagttttctagaagacttagggaacaattatcatacctcttataactcaggtcagaaatattgatcattgtctatatcatagtggctatggtataatcaaagtatgccagttaaccagagataacagagaataaccctcacacagacctgccctatggtggtatcaagctatttctccctttctaatattattctttgattattctatatctaaagacagatttatcatttattggcataacaggttgcactgatgatatatatttcaaaaatatgatactgatactatttaatgaaattgaagagctctagaacgagtttttagagtggaagcaccacggcatatagtcatgtagttcgtgcactgtacaactctagagggaggttgccatttacatcagagttcacaacctaaaagggggccctggataaagatgaattggggatcatctttaatctagtgtcaaggtctacgtttcactgtttaaatgctaccaaatagttttctctgtaattgttgctatcttcctagccatccttagcaccttaaaaatttactaagaaccagtggctgttcagatcctctttgttgatgacctggatagcattgagctaacccagattgcaccagaagatgaatagatgtttgtgttaggctgttcttgcattgctgtaaagaaatccctgagactgggtcatttataagaaaaggggtttaattagctcctggttctgcacgctgtgcaagaagcatagtggcatttgcttctggggctcacttatcaccaaggggatggcccaagctattcatgaaggatcctccatgatccaacacctcccaccagctcacacctccaacattcaacatgagatttggatggggacacgtatccaaactatatcaatgttccagctgaaaaagagaaaaatggctttgatgtgcaatgactaaaggtttcaaacttcacagattgccctttgattagtgatcctagagactttatgacctaataggacattctcggtttatgcagaaggcagtaggagctacattatttcaaataccataaaacttctccaaaaacatatgttcagccttgaggaaacgtattccagatctgacaactgaaagcagtctgcattaagttcttgatctatatatttttttcaagatgattgctggggtcatctttcattctggcctttcctacctgcatttggaagttgagtagatcctgcctgtagtgaaaaggcatagtttattttgatcagaggtctcagttacagcacatagtagtcactcactgtgtatgtacactgagtcactgagtacacgaatttgcctttgatcatatcttgtacaccacttaggtcctgccctacgagttagcaaagctcaagaatgagtctttagacattcttaaattgtataataacattttgaacttgatgtctttcacctgatggactcaaaacattttacttacaaggagacaaagtctcaggaggctggcattgtgttctggtagaaagagtaagggttctgccaaatagctgaatgaccttgacccatcccctagacttgcaggggtgtccaatcttttggcttctctgggccacattggtagaagaattgtcatgggccgcacataaaatacactaacactattgatagctgatgagttaaaaaaaaaaaattgcaaaaaaactcataatgttttaaggaagtttacgaatttgtattgggccacattcaaaaccatcctgggccacatgtgacccgggggccagggttggacaagcttgcaatgatgggacctctttcatctgtagaacgagggttcgaggataggtgatttctgagttcctttccagaaataaaccactctgatactctctccccaggctacacttaaatacttgtgaattaaatctaagtcaactccaccagtttcaggtacagtcaagcctatttgtagaggagagcattttctgtggcactgaagttcactcaataatgccttcattttttttttttaaagcagtgcttttggaggggggacagagttcaaaaactttaaaaaatgttaatttttaaactttttattgaaacttatggcatacatatatgtgtacaactcagtgaatttcgtgaactgaacacacccatgtaattggcacacagaatattctcggtacctcagaagcctcccttgtgcccacatccaatattgttataactccctccctttcaaggataacccttctcctgacttctcaccacatcaattagttttttctgcttcggtttctcatgaatggaattatgtacaataagcactcttttgtctctggtttccttggcaaacattatatttctgagctgcactgagattgttttgtgtagctgtagcagacacttagatctttcctccagagagacatcgatacatctttgcacaactgtgttaacatcctcatttgagtgactcctttgggaagatcaataacatgccattatgcccagagagaggttaaaagaggagggagaaattagaggctttttataattgattaacatattctagcattaatacataatacaatttattaatttaagatatgcaagccctcttctgaaggagaaagattcacctcctggtctaaaacatcatcatgtcaggtcaaggaaagaatcactctcctagtgctggttatgagtattcaattacagaattcttaaagattgccagctttaccttgagacagaaactctgacttataaaacccctttctttccatgccctccaccccttaatcccagcactgcctgatcctgcacatactaggtgcaaaatagatatttgttgaatgaatgaatgaatgaatgaatgaatgaagagcacagctaacatttacagtgcattcacagtgccagccactgtgcaaagatttcttgtttactcaccgcaacagcactatcaggtgggtgctgttgtctcagtttgctagatggggaaacatgaccattggaaataacttgtccacagtcactcagatattatggggccaagttgggacctttgaactcatgctctttagtcttcaccactgtgtattcacactcactctagggcttgcagaagctgcaagtggtggctggattcatgagtgcccttggccgagagctctgctagctgaggacacacagcctggtttgtcccagccacttccctctggctgtgtagagggagcctgcccagttggctctcgccacccccttgcttgtgcctgtgcccatgagtgattcctttctcagcaccccacgccagcctctgctcctagtgctgactgcccatcttggggtaatgttggccaactcccagacatgagaggatcagacacagtcttagcatttgcaattctttctgtgtgctgaactctcccctagcccctgccccacctccagcacgtgcatttcatctagttcactcctattcagccctcacatctcatctggtacatattggccctcaataaatatttgttgaatgaataaatgaatgaatggtaaatgaggcttttaaattcaattctgatataaactactgaaatgcaagcaatgatgataaaataatatgcaacaaaaaggaaatgcaatgtactgatgaaactggatagttcccttgacccctctgtgggattcatgaaggagtggctcgcttactcagcccacagctctcaacccctcgtgggagggggagcacgcaggtgagtgggtacagaggccaggttgagtgcttctgggcaaccagcaggagcaggactctgtgcaggcccacagcagcgtctacaggttgcccgcgacccccgagccccagagggcatgtgttaccgcgcattcttttagcattgccatccttggacagtgtaagtgttaaacagttcagtggagggtcagtgtgacagcctcttgcacctgcaccaaggtctttgtctggcatccaggagtaatgaagttgtaagaacaaattggagggtggtgaatgcagaggattttattgctgatgaaagtggctctcagtgggatgggtggctggaaaggggatggagtgggaaggtggtcttcccctggagttcggccatctgcggctgaactcctccgaagtcgcactgtcaagccatccctctgaagtcaagctgctcctctccaaggtccggctacttctcttctctcctctgccactctgccagtggggcctgggatttttatgggtacaggatttgggggcagggcaggccagggtggttttggaaaaggcaacattcgggcagggaaatgagaatgcatgttctcacttttggctgcgggtccaggcttgagggtgtggcccttgtctagggccacactcttctacccaatatttccctgcctcctgtccatatcacttatccttttacagtataaaacatacaagagcgaaactccgtctcaaaaaaaacaaaaaacaaacaaaaaaaacatgaataggagctgggcacagtggtgctgcctgaggcaggaggattgcttgaagccacagtatactatgatcgcacctgtgaacagccattgcactccagcctgggctacatagcgagaccctatctctttaaaaaaaaatttttttaaggaaaaatgacatagagaaggataattattgaaaagattctgtgtaatggtaataatgatgtaacattttgtgttttttattccttctcttgttattttgcatgtgttgatgttttccataaatccacatggactaccttgcttctaagtataacatcctactgggcaaccctcccataataaacatgggttttgcttgttgtcaccagtgcccaactggcgtttctgattctctggaaccatagcaatttgaagtgcacaggatcacaggttgccttggttgaggaatgacctttgaggtattgctgtgttgtgattatggcagctgtgatgatctgtcttctccttactttattccaggatggttttctctgtcaggcagtgtggccatgttggcagaactgaagaagttttactgacgttcaagatattccttgtcatcatttgtcttcatgtcgttctggtaacatccctggaaggtaatgtgtctgtttttcttcattttttttttttctgtttatctgcatgtgtgtatttttttgttatttaggatttttttactgtggtaaaataacataatatttatcattttaaccatttttaagtgtacagttcattggcattaagtacattcacaattttgtgtaactgtcactgctatccatttctaaaacgttttcatcatcccaaatagaaactctatatccattaaacaataactcccaatttccttcccccccaccccttcctggtaacctctgttcctgttctttctatgtatttgcttattgcaagtaccttagataagtggaatcatacaatatttgtccttttgtgcctggcttatttcacttaggatgttttcaaggttcacccatgttgcagcatgtatcagaatttcattctttttaacagctaatgtttcactgtatgcattgacccattttgtctattcattcatccattgatgggcatttgggtcgtctcccccttttggctgttgtgaataatgctgctatgaacatgggtgtacaaatcactatttgagtccctgctttcatttctttggggtatatacctaggagggaattgctggatcatataaccctgtgttgaacatcttgagaaactgctaaactgttttccacagtggctatatccttttacatttctacaagcaaggcacaagaattccagtgtctcccattcttgacaatgcttgtattttcctgttgttttggtaatgggtgtgaagtggtatcttattgtggctttgatttgcattttcttaatgattagtgatattgagcatcttttcatgtgcttattggccacttgtatatcttctttggagaagtgtctattcaagtcctttgctcagttttgaattgggttgtttttgttggtgttgagttttgaagttctttgtgtattctggatattaatcccttatcagatatataacttacaaatattttctcccattctgtggggtgtttcttccactttcttaatagtatcatttcatgcataaattcttttaattttatgtagtctatttatttttacttttgttgtctatgctttggtgttatatcaaagaaatcattgccaaatccaatatcatgaagactttcccctatgttttcttccaagaattttatagttttagctcttatgtttaggtcctttgatcgatttatcatttttgtatatggtataaggtaacggtccaacttcactctcgtgcatgtgggtattgttttccagccacatttcttgaaaagactgcctttttgctattgaatggtcttggcaactttgtcaaaaatcactttgttataccagtggagggtgtctaggtttttggcatcttgaacaaataattggacaaaacgcactaacaaagcaaggaaggaatgaagagatttattgaaaatgaaagtacactccacagtgtgggagtggcccgagcacaggggctcaaagtccctgttacagaatttgtgggagtttccattggttacttggtgtatgccctatgtaaatgaagaggatgaagtaaagttacaaagtcatttactcagcatacaccctatggtgaggatatttcctgtcatagctgaagtgtgaatcggccttatgttccctgcctccagaccctattttcctgcctcaaagtgaccgtatagatgagggtttatttctggtgtttacttgtttttaaatgtatctacttgaaggtacaaccatatggaaatttaaaggtggtagagaatcagacagatgaagcagcctggtattttcggaaagggggatctttagaagttcatggaacaagaagaaaaggcatctgagaaaagcagttgaaagaccagcaatgctgggcctgcaatttctgtgggcacaactgccaaaggcaagtgtaaagaatcctcattaggaggttcacacctgtaatcccagcactttgggaggctgaggagggaggatcatttgaacccaggaattcaagacaagcctgagcaacatagtgagaccccgtctctacaaaaatgaaataacatgaaaaattagccgggcatggttgcgggtgtctgtattcctagctactcaggaggctgagatgggaggattgcttgagcccaggaggcggaggttgcagtaaacagtgaccataccagtgcagtccagcttgggtggcagagtacaaccctgcctcaaaaaaaaaaaaaaaaaaaaaaaaaaaagaagcatcctcattaggaatgggactaggaaatgattgatacttaagacatcaaggacacacaacgaaataactttcttattcagaagtgggtggcaggaccaaggaatctttattgcataagataaaaatctactagcagcaaacaacaaaacatacaaacaaataaaacacacatacaaatacacagactaaatggaaaacttcccaacaagctataacacaattggcaatcctttaaaaagtaggtactggggcacgttgtcaaaaagccgccattctttaaagaaagaaataatggccgggtgcagtggctcatgcctgtaatcccagcactttgggaggccgaggcgggtggatcacctgaggtcaggagtttgagaccagcctggccaacatggcaaagtcctgtctctactaaaaatgcaaaaaattagccgggcgtggtggtgcacgcctataatcccagctacttgggaggctgaggcaggagaattgtttgaacccgggagcagaggttgcaatgagctgagatcatgccattgcactccagcctgggtgacagagcgagactctcaaacaaaaaataaaataaaatctaaactattctcacacgcaccatctccttagggcactgaaacattactgtgggcttggcagggcaaaactcaagagtccccactttactgatgagtaaatgtccccagggaggttattggttaggaagtggcggagtccagattagatgctagatcttcagtctcacgtttcggtgctttttccaccacaggggtagatgaggcaggaaagtggaacacaagggaaaaaattcatccaaatgaaagctgtttgttagaaatatgtctttttgaaaaattatgttttaaaatgccaacaacaggggcaggtaaataggaaagtgcatggctctgaaacaaacctaagtagggaaaagctgagtgatcactcaaggcagctgactgcatttcttgctccagatctctgatgaattgatttcttaaagcagtggttcccaaagtgtgacagacaagtagcactggcatcacctgtctctcagaacgcccagtaagagtatttattcatgttatttatttattttgtttttgtttttgtttttttctttttctttcttttctttacttttttttttttttttttttttttgagacaggatcttgttgtcgcccagacttgagtgcgcgatctcagctcactgcagtctcaacctcccgggctcaggtgttccttccacctcagtctctggagtagctgggactgcaggtgacatcaccacgcccaactaattttttaaattttttgtagagatggggtctcgctatattgcccagggtggtctcgaattcctgggctcaagtgatgctcccaccttgcttcccaaagttctgggattacagatgtgagccaccacgccctgctcatgttactgaataatcaccttgatagcactcaccatgtgccagccactgttctaagcccttacaaatggctaattcatttaaagcccactctataaccccttgaaaaaggcactattatcagcttattttacaggtgaggaaattgaggcacagaggagttaagcaacttgccttcggtcaaataattaagaggttgcagagttacaattcaaattcaggccatctggctccaaagcttgtatgttggacctctatactatggtgccttttcacattcttaacctctctgctatgctaggctcagttgcttggtagttgtgaatctgtagattaaaaataaagatggaatccataattgtgagaatcaatgttgttctggatcacccaggtggttcataggcaccgcctcctccaatagctttggactggggcaggggttcttttagttcaggatggctcaggcctggtttttgaaggccaaggggactgacctgccacttctccactgggttatcaattgtgcgataatgattgcctgctgtgtgcccagcagtactggctgctgagaacatcgtctctgactccagggaattcacactgcagttggagggccgtgactatgacgcatgagaacaatacaaactataagtcttaaagtatgagtcagcgctatagggcactcacatatggcctgtggccagatctgtggattagtctaattcgatgctaagccacctatagcagatgctattggtgccctgcctatacccccttggcccaccccaggggtcacctgcagacagttcctgtggatgcttacggctttcatgtctccctgaggatcatctatgtccatgggagtgtgcttggcccatgtgcgggacaaaccagaagtgccagggagataacacccccaaacagtgagtaatgggagttggtatttaaatatgccagcttccttgtcccttggtgggaccacactcagatgtgttctatgttatctcccagagttccccagttgcattgtaccccataatactcatctgctcatgaatgtgcccatttccggattcacccccttgtctgtctcacttgcatattcccccactctgcttctggggaccctccctattgggaaactccccttccaaagttgaggccaaatcttactacctctagaaaacctgccctgacctcggaagaattaaatccccctccccagtgcttgcttctctttatccatccatacctggggatatcactttgtgtcacactcattacgggcttcctttgtactgtgagtccttgcagtgtgcggtcagtgccagacaaaaggttggcgaggcgggtggcgaactcacgggagggaagctgatgggcactgagagcctgctcagggccactcttccaggtgctttacgcacattatctcatttaatccttacaaaacctctttccggtgggtagttttcatctcggtttacagacaaagaaactgtcaaacaaatgaaggcatttgcctagaggtcccacagctaggaagattccccatcagaatctgtagcctgtactactcacacgacaccaggctgcccagggcaccctcagtaagtgtctggggactgaatgagcatgtcactgaggtgcagggctaggggagtggagagggagcctggggtgagctgttagagagcagcagctcccccgacccggggctctgggagatctggaccgtaaacacagtagcttcaccctggaagcctgagaggtgactcagtagctcttgacggcagggagaggtgggatgacactctctcgtcaggccactagccaacagagagagcccgtggaccttaacactttcagttgtgtgatttggtgacatttgaggggctcattcttggtctaccagaatgggttttggcacctccagcctccagctctcctgggcggtaccaatgcctttttttttttttttaaatctttgaaggaggtcttcttttagatacaactattctattttccagaggggcagatgacataatagtggaagatggttataatttcattcttgcagagttgtcttcctcatttggaaacaattacacatttgagccagtttggtgatctcatgagctacaatccccaactttctctctgggctgggtctagatctttctgtgctgcaggcatttccagcgatgagtccctctataattcccctctctgaggcctggctgtctgatttcctcctatcctctcttgctgtgttcacctgagtccttggtcttccttgcgaggaagtcggtagagctgcaggaaatgggctgcgtgctcctgagaggcgggaaacctgttctgtttcattttgtcctctaataccagaccctgtcctggtctcctcattctctctcaatcccctgtctgtacaaatgaggttataaatgcttaccatggcactgatctgatgctcagccaatctcacaacccccactgacccctgccaaatcttactacctgcacccaggcatgaggccatgtctgttggaccctggctctttccctagcaggtggaagtggtgatggggagtgatggagagtctatcatagataggttgcaggggaaactgaaagcagagggcattgtgtcccactctccacttggaactccaggtaaggactccttatgggccctgtgtgtcagcacagggcagttgcagagatgaagtggcaaaactgtttcctctgggagatgatgtcccctccaagtctctctcagctctcatgtggtagagtagggactctaaagtaccctcatgttcttagtgggtagctgtgatgagatccaggggtggggacagggctgcaaagactatggcatggacagcctaggccaggggtcagatggaggatgagacagacattcagtggtgagagctcaagggagctgtattagcaggagaaggaccccccaggcctggatgggattctgaagaatagaccatgggcccactggacacagccttcagcagtggacaccagttggatacccaggagccctgcaggatgagggaggtctctggagaggccattgagaactcagggctcagcactgggtgagctcacagatccaggccccttctccctgctgccagaaaggccctagcacgccattctcagcccaggcgccatcttgactaccagaaagaaaaggagggtggacaaagattgtgcatttattcacaagtcattgggttaactagagaccattttagagcaaaagagacaaagctaccttaaatcatcagacttaaggatctctttcctatatttctggagtggaggctctgaaacaaaagggagccaccctagatatcaaaggcagctcaggaatttttggtgtgttttggtgctattgtttctacatctaaattgtatctataaattttaaacttgctttaaaatgaatacatattgaacacagaatgatgtgtcagggcactccattaggaattgtgggaggccatcatcatatcttgaactctgatcctcctccaggttttatcttttcaggtatgtagagacatcattcaggtcctagagggtaatggtgacatcttttctctctttgtagcctccatattttctagcacatagtaagtactcagtaaactgtggttgtctaattggtttcgatttgtgaccctagtctaaagcctagagatattccaaaaagtgggccccccctcagcttacatcagcagtactatgctcatccgaacccagtcagttctgatacagtgtagactactccaaacttctgtatagacttcagtgaggtggctgtaccttggctaggattacccttgaagaatggatttcccctcctccatatgaggaaggagctcaactgattccccgttaagattccttcacagtctgacattctgtgagttcaatcagccagtagggaccatcttcagattcttcattcattgtcctggaataccagggatcctcgaacattatgtcattctggaagtccttgggtgatgtctgagctgctgattatttatgccaggttctcacatttgggtgcacattggaatcacctgggggaatttaagaacacctgcctcggccgggtgtggtggcttacacctgtaaacccagcactttgggaggccgagccacgtggatcatttgaggtcaggagtttgagaccagcctggccaacatggtgaaaccttgtctctactaaaaatacaaaaattagccgagtgtggtggtgggcacctgtaatcctagctattcaggagcctgaggcaggagaattgcttgaacctgggagcagaggttgcagtgagctgagattgcaccactgcactccagtctgggcaacagagcaagactccatctcaaagataaaaaaaaaaaaaaaaaagaatacctgcctcctacccccagagattctgacattattggtctgggggcacagcctggatattggggttcttcaaaataccccaagcgatgctagcagaaccgagaaccactcacctctgcaatcccattttaaggctgttctcctgttcaaagtcctaatgtgaaattggaaacaatttataagtcacattttttcgaactacatttattatgtgaggcaatttcaaaggcttttaaagttataacaaagccagtaatctcttgatttcaaaatggataaaagctctagaagtggctcttgccgactggcaaatcccccaagttatcgttgctgtccttgccttgctcttcattgaagaatcccagtgtctcttcatagtatcttatttatttatttatttatttttctgagacagagtctcgctgtgttgtccaggctggagtgcagtggcgcgatctcggatcactgcaacctccgcctcccggcttcaagcaattctcccacctcagcctcccgagtagctgggattacaggctcgcggcaccacgcctggctaatttttgaatttttagtagagacggggttttgccacgttggccaggctggtctcaaactcttgacctcaggtggtccacctacctcggcctcccaaagtgctgggattacaggcatgagccaccatgcctggccttcttcatagtgcctttagtaccagtactgtgtatactaagacagattctttagtactactacatagtactggtactaaagacagattctttagtactactacatagtactggtactaaagacagattctttagcactactacatagtactggtactaaagacagattctttagtactactacatagtactggtactaaagacagattctttagtactactacatagtactggtactaaagacagattctttagtactacttcatacatagtactggtactaaagattaacaacagcagcagcaacacaactggacactcctgtaggtctttgcggttgacgaagcaccttcgcatacatcatctcacggtgtccccttgaggttagtagaaaagtttgtgttatcctcactttgctgaagagaaaactgaagctcaaagcaatggagtgactttctaggttacccagaaagaaacagtaccaagatccagaaagtgcttatttttggcttggacagtttgggtaatttccaaattcacacagctggaaagtggaggtggtgagattctagaactcgtgttcttaaccacttccccaatatttagtcctgaagcattaaaaatggttttcttgttgttgctgttgttgttttagagcctgggtctcactgtgttgcccaggctggaatgcggtgcctattcacaggcgcaacaatcatggctcactgcagcctcgaactcctgggctcaagccatcctcccatctcgacctcccgagtagctgggattacaggtgcatgccaccgtgcctggcttgaaaatggtttttacacaactttgcatgatttgttcatcctgggatgaatttatatccccaaagcactgtataaagataaagagtgatctaaggcataaaagcaacagttctgctgatttaacctattagggtttaagttgatattccaagagaacacgctgttgaaatgcaccttaatagcattccttagttcaagaaataacaagaaacacattgatcttgccaagaggcctcacatttacaagatcacagggctgtaaaaaacatcaaggtaagttagagatacttttgcaatgatgtttgtgatgtgatgtgtgttagtctttaacatccgtgtccagtgtgacctatacccttttgttacttttcttttagaagtgaacagagcataaagtaaaagttactctaatgttgctatagtatttagtacagcatagagttttttaatttgaagaagagataaacaaagatataaaatggcagtaattttgctttagtgtgtaaattagaattgcttataattatctgattaattgaatgaacaggaattgaacacatagctctgttgtctttcaattatgtagacatttttgccttgctcctaacttgaaatatgatttgatattacacagattgggattcacagtgaagtctaaccaattctgggttttggtgtacacaagcagaaggagatgggtttgaattagtgagaagttttcagttacaggatgttttcaaagtagagttttaaaactttgaagtgagttgcataatatgactagaatgtaaactctctttgaggccagggactttgttttattccctgctataacccccgtgcctggcacacagtaggccttcaaaaatgggattaaaagaataaactttggcaaatgacttcacatttctgagcttgtgtttcctcacttgtggactgaaggggttggactattttggtatctggtattttccccacccatgacctattttgtaattcttttcttccagtgaactccaagccctaaaagatgcttttgcacaatttatttaagtaagattgttctcatttttggtgttgagtaaaaacatatatgacagtatccagtgtttgtgatcagcagtagaaaaccagtattgatataatcccaaacggtacaaacattatactctatttttattttatttttattttttagagacagggtcttgctctgtcaccaggctggaatgcaatggtgcaatcatagctcactgcagtctctaacacctgggctcaagcgcacctcccacctcagcctcccaagtagcttggactataggcatgcaccaccactcccagctaattttaacatgtttagtagcgatgaagtctcttcatgttgcccaggctggtctcaaacccctgggctcaaactcctgggcacctgcctcggcctcccaaagcactgggattacaggcgtgagtcatcgcacccagcctcagcctcacactctaatttttgtgtgtgcagcctattgtggataaataagcgatttttgaaatgatgaaagtaccgtctaaatgactacctttgcaaaacgtacagtattgcactaggtcatcttcaagtctcctttacctctgaagtggatttctatgaacttcagtttcctgatgtgtaatacgaagggatggaaccccatgatctttgtaggaggtgccttcctatgatgatcctaaactatggaaacttgaattagatgagcacagtgttctaacagacattctcactaacctagtgttagtgaataaataagaatgttttatagtcagaatggaaatctcatgcatgtaaatcctggaagaaaccatcttcatgattttttaaaatgccctctacaaattactgataccacattgtttgcattaagtgagaaaagtagtttattatataatggtaaactttatccaagggcacagaatcatatagtctgaattaataataattacaccttattgttgaaactgtgataaaatgcttgataaatgtaatataatttcattcaaagaaatcactcccattttacagataaggaaatacaagcagaggaatgttagaaacttactcaaggcagagccaggatctgaacccaagtcagtctccttaatcacatttaaggcttggctcagcaggcatgttcatttattcattagaaataaatgaacacagacattttattcatatgtaggagattaccaaatcagagttacagattattaaaagtgagggatctcagatcaaactttcaaagctcatgacaagccaaagaaaataggaggagaagacattattagaacaggagctaccaatgtataaaggctggctaaggattttctgaaggttaagggttaacgtggcttcaaaacagaggcaacttaaaaatacaatttttccaactaagtaggatttctatgcagcaggactatgcctaattccaaccctcttaatggttttttactagcatgtagttgtttatagaactagttcctcacataggagtcccactttcaagggtcccggagaaccacgatatgaacattcgctaggagcaaagctgatagggtgagtcataaagaaggggctgttcatattcagcctcaaagtggcaaggacttctcctcctcgggttcatgctgactgcctgacttttgaccttgtcaatatcatgacaaagaacaagagagaaaatggtggctggggagagtgattttagcattaatcttgtcccacccttagtttaatgggcattaattacttcacagcgctcaaattaaatctgatgtggcagagactggctggcaccaaagcttttactttttcttcctcagcacacagctaggctacatttcccaacctcccttgtagttagaagtggccgtgtaactgagtgctggccaatggatgtgggtataagtgatgtgtgccacctccaggcctggtcattaaaaatctcccacctggccaggtgcaatggctcacacctgtaatctcagcactttggaaggtcaaggagggtggatcacctgaggtcaggggttcgagaccagcctggccaacatggtgaaaccctgtctctactaaaaatacaaaacttagccaggcgtggtggtacaagtctgtaatcctggctacttgggagactgaggcaggagaatcacttgaacctgggaggcggaggttgcagtgatccgatattgtgccactgcactccagcctgggtgacagagtgagagagactccatctcaaaaaaaaaaaaaaaaatctcccacctgattcccatcactctctctctttccccgtttgcctgccgcatcgtgctctccagagcaaacttggaatctgcatctgacacatggtgagaactcagtaaatactagtaattatcactatagaccagtgctcatagaacatttttttgcaataacggaagtgctctatatctgtgctgcccaaaacagtggccaccagccacatgtgaccacagtattgagcacttgaaacttgactggggtactaaattctaattatgtttaactttaattaatttaaatttaaatagccacatgtagctaatggctaccatgttggacagcacagttatagaccatttaatctaattgcttcagaaggtttctatctcaaactgtgtaagtcaggattcaatcacaggagaaccactaaggtgcgtgcacgcgcgtgcgcgcgcacacacacacacatacacacacacacacacacacacacacacacaaagggatttgctacagggatttgtcctaatacaactgtgggagctggttaagcagtctctataaagctctcatcttcacatctgatgttgggactcgacatctatcggacaggcagttgggaaggaaggataaatgtaaaataagggagagcaagaacaacctggaaaccagaagcatgcattgtagcccacgagaacagactgagccccacgtcgcttattgttgcttttgaccttggcagtatggatatcctgcagaagctgggcgcttcatcataaagtacacacatggccaaggagccgaagaagctgaaaaggaaaacccaggagaaggtggagcagttacaggccccgcacctccctggtcctaataagatgaggcaactgatcattgccaacctatgtgagctacaacatggctgctgcccacatctgcccagatctcccacaggaaactctcttctgtcccacgttaattagaaacatgcaagaaagggaattttgggaaatgtagttggtctaacgaagatgatgcattatggagccaccacacatgctagcatgctaatgagctcaattttctatctgctaatacttctaaataaaacatgaagctaacatctcccaaggctctgttttgttgtttcagttctgcaactggcctagagaattctgaagatccttgcagccagctaacgttatctttgagtggtaagattaggagtacttttcaagtttttccttatatttttctgtggcttagaattcttcccacataaacccacattatgattgtaatcagaaaaaaattagttactttttagaagccagcctgtgacccctagggagaccatgcatcccacttaagggcaacccaataacatcatgattaactgtgtcttctacattcttcctggaaatttcacctgttcttgactttgtacaagaacttataaaacgtaagttatggtcatcagatttcctgaagccctctgcttctctcctcccatgttctcaaagtgatcccaaggatattttagaaactggaagcaaataatataaggagaaaagaaactggagtggaagtcttgcacgtagaagggagaaatcatttttagataagtcactgggaaagtgaagaatagagagcgcatccttgatatggtttggctgtattcccacccaaatctcatcttgaattgcagctcccataattcttacatgttgtaggagggacccggtgggagataattgaataacgggagcggtttcccccatactgttcttgtggtagcaaataagtttcatgagatctgatgtttttataagagatttccccctttcacttggctctctcttttgcccgctgccatataagacatccctttgctcttccttcctcttccaccatgattgtgaggcctccccagccatgtggaaatgtgagtaaattaaacctctttcctttataaattacccagtcttgggtatgtctttatcagagcgtgaaaacggactaatacagtcattgtattaactactgacttgagcagtatttactgtgtattcttctcaatactttaacagtagtacctatgaagtatgtcctgttacacttatcttcgtgcctgtttttcacctgggaaactgaagtgcagatgggttaagtaagtggtcaaagttacatagttagcaaatggcagagccaggatttggacctaggccgtcctggtctttggagtctaggctcttaacctacctgccacactgccttctttaggggtgcaggacagggtcacgtggactatgggagttcgatagattaactgctggcaggccgattcctgtttcttcctcactcccacatcccagtgaccccccctccgccccgcaaaatcctctcacttttaccttagtaggatctgttgaacctctcttttcatgccagcttcccaagcatgggttcaagtcctcatcgtgtcttgcccaatgtacccctgtagcttactctctggccttcccacttcagatttccttcatttatttcatagttatacaaaaaatattgttctgtgtcaggaacaggggcaagggggaagggagaatggggagttattgtttaataggtatggggttttggtttgggaagatgcagaagttctaaaaagagaaggtggtgatggttgcataaacatgtggacatacttaatgcaaccaaactgtacacttaaaaatggttaagatgaggccgggtgcagtggctcatgcctgtaatcccagcactttgggaggccgaggcaagcggatcacctgaggtcaggagttcgaaactagcctggccaatatggtgaaaccctgtctctactaaaaatacaaaaattagctgagctgagcatggtggtgggcgcctgtaatcccagctactagggaggctgaggcatgagaattgtttgaacctgggaggtgtaggttgcagtgagccgagatcgtgtcactgcactccagccagggcaacagaatgagactccatcttggaaaaaaaaaaggttaagatggtaaattttatgtgttgtatatacatatgtatatatatataaacgtatatatgtgtttatatatagacataaaaacatatgtatatatgtagcatataatttgtggttttatatatataaataatatataataaatataaaaataataattgttctgaaatgtaccttaaaaagcctctactgcatctccttctccacaagataaagcccacatttcttagcatagctttcattacttgatcatctggctcatgtgccatgcaggactgtagcttggccaccatctttttgtgccgatgactttgtgatcaaccactcctctttggcccttctcctggaaagaccccatagaactgagagctatcattcagccttgccgattatcatggaagtagcaggaatgatgggttaataaggagatagacttacagacagcctctcaggtggccagacagcatagagtgaatggagatggtatggcttagtgaaagaggtatgggctctcaagtcaaacaagtctgagtctgagttcaggcttaccattaaactctccatctgtgaaatgaggatgatcgtttcctattgtagggctattgtgaggattattagcaatcatgccccagatatagtgggtattcaatataagatatacagtgtgaattctctttagctcagactcagttaactaagtttggaaagaaagacatgggtggtattccagttatctatttctgtgtagcttaatacaactgtcatttagtttgctcacagatctgtaatttgggcagagctcagcaggagggctcattcctagttcacatggaatcaactggggcatcttggctgagggctggatcctctgcttccaggatggcctgtgcacacatctggcaagttattgctggctgttggctgggagctcagtggaagctgaggactaggaacctcagttcccatgtggcctctctacatggcctgagttctaaggataagagagagggagaaagagagagagtgagagcaagcaggcagaagctctgttgccttttgtcacctatcctctgaagcccatagtgttacttgcaccatattctcttagtcaaagcccacccaggatcaagagaaagggacataggttctacctcttgacagaagagtggcaaagttctggaagaacttgtgagatgagaaatattgctgtggccattcatggaaaatgcagtctgccaccaggagttttcagcttctaccttaaggctttggacttggaacccatagggaagtgatttctgaggtttacagagtgtcatggggccgggcgcggtggctcacacctataatcccagcactttggaaggccgaggcgggctgatcacgaggtcaggagatcgagaccatcctggctaacacggtgaaaccctgtctctactaaaaatacaaaaaattagccgggcgtggtggtgggtgcctgtagtcccagctattcaggaggccgaggcaggagaatggtgtgaaccaggaaggcggagcttgcagtgagccgagatcgcgccactgcagtccggcctgggcgaaagagcgagactctgtctcaaaacaaaaagagtgtcatgggcaccatgtgcgacatggaaccaggaggtgggggacatgagttttaatcgtatcaccacgcagcagtctcctcttacacaaagcactcacctggagccctggacttgtcatttgtaaccagatgatgccctcttcagctttactcttctccagttctctgagactgtgaggtccgggcactgtccattccaactccgacatgtcagccatggctgaatcagtgcttctccatccatcttcttttcacatcggaattgctagaggagctgtcaaaaatgcagatgcccaggttgaaatgatcaggggtgggatctggacatcagtcatttaatttaaaaaaaatttttttagagatgggttcttgctgcgttgcccaggctggtctcaaactcctggcctcaagtgatcctcctacctaagcctcctgagtagctgggatttgaggtgctagccaccacgactgactacatcagtaatttccctgggggtgatattaatgtgcagccagggttgagaatcggtgagctccgccattgtgtccatctaagtgtgtacaggagtcaatcaaaggaacccaagtgtagccattgcttttcgtgcccctgtgacatccttttgagccatctatgagaccagccacagaagaggtggacagttctatgctcgcagacttctgtctgcctctggggtttcccccgagccctggcagcctgctcagctgtcacaggaagagcccaggagtgcagaggaagtaatggcccaggagcaaatgtcaactgttggggagggagacttggataaatgccccagtctccagcccttcctagagacaattctagaaggcattctctatgcttctcagaggtctctttggacttgagctcccactgtccacaacaaacaccccaaacttggcttccatccttccctgtctctttctccctgcctcctgggattacctcccaaagaaagtacttgcactccagtcttgatcttaggccctgcgacccagagaacctaaactaagatgccaagtgatcactgctcaattgtgaactggcaaagagtggtgtgaactaagggaaattggaaaaactgctcgccacagccaaaccactggtgcacgcacccctgccacctttccaggcacttctgcacttaaaactcccacaagcgactcttgctaacccatacatgacagatgctttgatgagaaggaaagtgtcagctggctagcagcagaatcactctagacactagtggagttggggaggagagggttctttcttcacactctatcttttctggaggaagcagagataaccctacagcaggggtgtccaatcttttggcttccccgggccacattagaataagaagaattgtcttgggccacacgtaaaatacactaacatgatagctgatgagctaaaaaaaaaaaaatcacaaaaaaatctcatagtgtttcaagaaagtttatgaatttgtattgggccacatgtggcctgtgggctgcgggttggagaagcttgcctaggtcatgcattctcagtggaggcgctatcatccccattggggtggaaaattggttcttggtagcaaaacaacaacaacaaaaaaaaaaaaaaaaaaacacaaaaaacgcttatatatgacacagggccaggactaggatgaggcaagtcaggggcccagggaagaaaatattaaggagacagccactcccagggctgtggatgtccgcatatggataaacatattaactcgccagatggcaacgagcctgtgcataaagagatgaaaaggatcaggcagaggcagaaagtgttgcagtttgaaatagactggtctggaacagcctctcggagaaggtgacatttcagtaaaatgtgtaggaggctctgtagcaaaccaaggggccttctgggggaaaagtgttccaggcaggtggaacagcaaaggcaaaggccctgaggtgggaatatgcttggtgtgttggagaaacggcagggaggccaggatggctgagtgaggggagggcaggagaagataaggttggggtagagagctgtctgtttcatggaaatgttggggcgattccattgagtgaggagcacaggtataaggccagtgtcatcagtgtccaataaaggtgagtcggcctcccgctttccccactcccaaagcgctaagcagcatttacatgtcgtcagactgaaatagctctagaagctaccagccttcggaagttacaccaatcacttcggaagtgaacagaaatcatggctagcattctaaatgaaaagcacagccatgacgctccattatcagcacgggccaggaccagcagcgtagattgctagccatgtgtctagtttcagaggcactgggaagggcggggaatgatcccccagtatcctctactggtcagaaagttaatttcaaggctctcattcttcctaaagtacacatccctcctggtggagcacggtggacacccagtaggtcagtggcccttccttctcttcagcccacagcccaagatgagaagcggcctggtgtagtgaagctggagagcctgcctcacatcctagtctgcccttttacatgtaatcttgggcaagttacttgactgctcttttcctccatttccctatctgtgaaatggggataacgtacctcatagggttgttatgagggctaaatgagctaatatttacgcagtgcccggtcatatagtaatgctgtataagtgcttgttaattaaagatagaccccctttgggggctctaatcttcccaggaaaaaatgcatatgaacacacatttgcattttatttcggggcatttatggacgctccaaaatgcatctcgtggacccttggggaagggacagttcataaagccctgagagaaccaggatgagttctggagggatcaagagccagggggatgggtgggcgatactgtgcgaaggcaggagaaaagcaagaattgggggctgggggctcaagaacacatttcaccttcttcccgttctggccaaagcccacctagaactgcggattgcttgcactttgggaagttccatcagctaagagccgaagttttttttaatgatgtcattattaatcatttaataaatacattatgtaagagtacttattgagcagtgtcccagcgcgagtaaacatgttttggatatgccaaattagaaatgttttcattcagttttgggggttatgtagtaaactcggaaaatgccgttcctggaagagtgtctgttatcccaagcccttaagagccagtgtaataacaacaaaaatattgttctgtttggggttcccatataagagtgcctaggcgtggtggcttgtttttaattatctctctatggaacagtaattcaatccagaggaggactgccaccagattacaagtttcagttgggttgaaaatattcatgcaaggagagctagttgtaatctttttagatccactcccaaaagattaagcctttttctttcccatccaacttggggaagaatgtggtggaagtaaatactcatagtagtaccacaatcataggtgtaagacaaccatctcacatttgaagtcttaatatctaccacggtgtcaaatagcagggagaaaaatgaacacttcagaaacacccagacatgatcttgcataactttggtgcaggtagtttatttgggaggtgatcccaggaatcaggagtgaaggagcaggcattaggaaaagagagaagggagaaggcattaagaaaagaggaaaagtcattaacaggtatgttattgaggtcaccactgtaggcaatgggggctcacaatggctgactttttaatgctgtttttgatatgtatttgggtggacattttagcatacatttgtaagacctgttaaggcatctatctgctgtgatcggcagctataactactcctccaaactttgaaatctgagtcatagtcatccaagaagtattcttgagtctttgctctgttgactctgcattagtcattttgccttgttactttcagatccattccccatccttcccttactctgtatcacagggacctgaccccttgcaatatctttcatgtctccttgccaactggcttccagctaggttcggccagtgggtgtcagtgacaggagattggagtgcaagaggaaaggggaagtcagggtatttctccccctctctcggtttggctggcatctctaatgggggctgtgcctcttccatgattccagtctcactggacagaccccttccaacatcccgtggcctgaactcctgccttgtggctctgttcatcggtatctggtaatattacctcccccctttgctcttccagaatcttcctgctgttgctcacctctggattgctccagttcttcatctttgcaacatttccctgtgttacattcctgctcttgaactacctgtcatgggttcccaactgatctctgactgacggagatttcttaaggatttcattagtcattgcaaaaatattttaggacatcaaccacaaacaagacactggactagattcctggaaggtaataaataaagcatcaagcagcttagcgtctagttgggtaaacaaggcacacagtggaaaagttaaatgacatctttccaaatgccaagtgaaagaagggcgtagtcaatgaatacttgaagatataaagaggagagagccagctccatcagcttttgtaaccagggcatgctttagagggccagggagccgacataaaggggtcatctcccaaaacttacaattttgtaaaacaaggtgaaaaattggaattttatttgaaatttcctgatttttaaatgttggtgagtaattcaaattttcagtaacttggagctgggcatggtgccacacctctgtagtcccagctactcaggaggctaaggcaggaggatcacttgagcccaggagcttgaaacccccatttctgaaaaaattttttaaaaatatccaggtgtagtggtatgtgcctatagtcccagctactcaggaggctgatgtgggaggatcccttgagcccatgagtgggaggctgcagtgagctatgattgtgccactgcactccagcctgggcaacagagcaagaccctgtcactaaaagaataataataacaaaaaactccagcatgattcccactatgtagacaagataaaacttgtttggaggctgaattgagactgtgggtgtacaattggtggatggattactgtatgggggaagaaatgggatgcagagaatgttaggattccttccaattagaaggttctaaggttctaattttacacccgggtatgaggcagtgacggcctgggtatggaagggggcagtgagcatggggagaagggacagatgagagagagattaaagaagattaataataaaaccctatggccaggcgcggtggctcacacctgtaattgcagcactttgggaggccaaggcaggcggatcacttgaggtcaggagttccagaccagcctggccaacatggtgaaaccccgtctctactaaaaataccaaaattagccaggcgtggtggcaggttcctgtaatcccagctactcgggaggctgaggcaggagaatcacttgaacccgggaggaggagcttgcagtgagccgagattgcgccactgcactccagcctgggcgacagagcgagactctgtctcaaaataataataataataataataataataacaacaccccccatttctgtattcgattatggtctacagagtttgtcattggaactgggatagagtagagcctcagaggttaggctcagaagtcaaactgccttcgttcaaatctcaggtctacaagcaatgatctgtgaggccttgaacaagtttctaaacctcacccatcctgtttctcaagcactaacaaggaatgatgttaatgatatcacctacctcttcagggtcgaggagtccttctcatggcataactctgacccactcttctgcctgcctcttccacttttaagaactcatggactagattgggcccacccaggtaatccaggataatcgatccatctcaggatcctcagtgttcatcacatttgcaaagttgttggctgattaaataataaagtatgtttgaagtccttcatgtggtaagcctggatcacaggaagcgtggatcagtttttgctattcctgttatgccatgtacattctctctttgagaatccttgcaacagccccatgctacaatgagaagactgcccaggatgcaatgactggatatggaggtgggagttggggatggggaggagtcaggagcaatggccagagagttagcatcttggtttgtagactcgactctattgttaaaagtaactctttgtttctgggctcttcacttgacccctgtaggattttctctcttgaagggcggttccttgcaactcattctccataatttaggaaactgggtttctgagtatggtggaaagactgatggctccccaaaaatgtccacatcctaaaatccctggaacctgtaaatatgttaccttacatagcaaagggaactttgcaggtgtgattaaaatgaaagaccatgagattatcgtggactacttgggtgggcctaatagctcttaaaagtgaagaggagtcagagtgatgccacctgagaaagacctggccctgtcccatcatggctgactttgaagatagaggaatggggcatgagccaagaaatgtggggggcttctagactctgggaattgaaggaatggccctcaatgtattgctagcaagaaaatgaggaccttggtcctacaaccacaaggatctgaattctgcttatcctgaataagcaggaaatggattctcccctagagtttccagaaaagaatgtggcctagcatcatcagcattgattttaatctggtgagactcctactggacgtctgacatgcagaactctaagataacaattttgtgtttgaagccagtaagttaatggtacagcagcaacagcaaaccagtactgaagttttcaacttaaatgtttggcgggtgttactggcaatacttttgagttcaggaactgatcaagggtggaaatgatgtggggtgatgagggatgagttcttggatatactgagttggagaagcaatgacagcaagacattcacatggcagtgctcgaaccacacttggccatgtgggattagagtttagaaggtagtggcaataactgaaaaaaaaaaaatgcctgggaggggatgtagggaaagagactccattgatggggccagtttcttgagtttccagttcgtctggctccatttggcttctattctaagccaaactcctgctcatcctaattggaatatatggactttgttttaaaaaaatcactagggagtcatactgagtaaattttatagacacggcaccataattttatttattgacttaaattgagacttccataaatgaataatgcttgaaaattggctctttgtaggttccaaaggaaaatctgaaaattttaaatgtttttcctttctttgtttatgaatctttttaacaatggaaatgttttgtctcctaagagtggcatggagctcaaatatatgactcactggatatgacgaccacctctttaagttgtaacaaatgggaagtgagttaggagagggcccaagagaaacataagctgatcctcagaaaagtgtaagtcctgtggggatacctctaggttggaccaggagtgaggtggagcatcataatgagagacagaaaaagtgaataaatgttagtgactgagcagctgggttcctaaaggaaaaagaaatgccaaaagaaaaaagcagagaagaatcatttaaaaatctctagctttaatttactagattccctcccttcatcaaagtagaccgctgtctttcctgtcaggagttactgagagccctgtacatttcatgatgaaagagaccagccctgggctggtccaacccctcatctactttttttttttgaaacagagtttggctccgtcgcccaggctggagtgcagtggtgtgatctcagctcactgcaacctccgcctcctgggttcaagcagttctcatgcctccgcctcccaagtagctgggattgcagatgtgcaccaccacgcctggctaatttttatatttttagtagagacggggtttcgccatgttggccaggctggtctcgaactcctggcctcaagtgatcctcccacctcggcctcctaaaatgctgggattatagatgtgagccactgcgcccagccttatctacattttgatcaagtttcagctcttgattataagcccacgcctatcaaactcagggatggaggaccagttttgtgagtttcccagaaaacttccttctctgctctggctcttctcttacccttgacttgtccatttttttctaataagtaagaaagaggtgaaactcaaatcagccccctgtgtgtacacagctgtggtcaacagatttggcagtggagaaggttggaactatggccatccaccgggcaaaattgtcagtgaagcaatgttagcctctgttgcccctcgacgtcactctccatccctcttctctggtacctaactcttcccaggtgccttcatcctgctccccgcctttgccaggtgcctgcccttcttcactttacctgcccacactgacaggtgtcattctgagggtagtccatattgaatgttgattttacccagggctttcccacgttgcccagtgtggtagctctttgctagatgatcagatgaattcacccaattcaaatgaactcatactaagatgtgaatgactgatgaccccttcagtgttcccaaaggtattttttcaattaaccctttcaggctgggcatggtggctcacacctgtaatcccagcactttgggaggccgaggtgagtgcttgagcctcaggagttcaagaccagccctggcaacatagtgagacccccatctccacaaaaaataaaataaaaaaattagccaggtgtggtggtgcgtacctatggtcccagctattcaagaggctgaggtgggaggatcacttgagcctgggatgtctgaggctgcagtgagccacaaccgcaccactgcactccagcctgggcaacagagtgagaccctgtctcaaaaacaaaattaaccctttaaaagctaactcaacagattagtggaatattaaagtagcatgagagatacagaagaacagagactaaggaagaagtaactgcaattaaattagggcaccaaagcacctagccacttgcctacatttgccttgttggctgcagggttattggggaacttgggcactcattcagtcctgctttcgagccgaactatgattttaattatcccagaaaacaatcagtaccctaccatcatttcaagaaaataggctcctggaggctaccaggtatgtttcactgtgcaatgttagtttgcaaacatacttattctttcctattaattgtatctcaagataacattgtaaaaatatccctttgtaattaatttttttaatgtataagataacaccccatgtgggtcagtatttggggatgtaacacttctaaagggtagtataaattggtccaagttttctctagggcattttgcaaacaacatttatggaatttctgaaagaaatagccacatatgtatgtaaaaatttagcccaaaggatttattgcagcattgtttgtaatcatgaaaaatcatacacaccaaaatgcccattaagaggaaatttgttatatagataaatagtacatacaacaattgaagtgctattcagccatcatagatggtgttgtggaaaattgtttgatgatatagaatgacgttcatgatatattgtcatgagaaaaatcaagttataaatatttttgtgtgatataatccttatacatacatatatatacatataaacatatatgcatgtatctgtatatatgtaaatatatacacatataaacacatgcatatatctatatatgtaaatatatatacacacatagagaaataatatatactaacatgttaatgtcatttttctctgagtggtgaaattatagatggtttttattttcttcttcttgcttatctgtaatttctcgtttctccaatatgtatgtattattttcatagatagaaatatagaattacttttcttttaagagatctgagcattttccccaaataaataactcagcagctcttgtagtttataaacccagaggtgtctgatctagcttaactcataagaaagaaatggcttaatagatataacgtctgtgctcaaaagcagcacagttaatggaagtttaatttatgcaaacatacacgttaaaaagtattgattaggctgttgaaaataatagtaaattaacatactgccctcttttggtagctatttgtaattcagcttacgttcacttccattaaagatgttaatctcctacaaatgtgtgcataaattaaactaattttatcttattttttaaaataaattttattgtgcacatttgaggtttataacatgatgggatggagtacatatggatagtgaaattgttacagtagtgaggctgataaacattcacatacttttttttagtgacatgagtagctgaaacctacttatttgacaaaaaatccttaatatagtacaattttattgattttagtcctcatgaaactaattctgaatcacctcttttcctcaacagaagatactgataattccagtttgtcaccaccacctggtaagttgtttttttagaactctggggaatttcaggaaaatattattctgtaagttctctatgaaacatggcatgtagtcaggtacaacaaaattgttttcctccaagaagcttaattaggtcattaagcctacacctgaaaaatcaatgcaagcatagaccagaggacagtcatattgatccgtccatattgcgggacaaagccaggcaacaaatcacaggggactaaattgttagttttcattacagtaattacttaagttcagcagttatttttagtattctagttcacaagtctcttgaagagtatcaggaacataaacatgccagatgtttttacatttaagggaggagatgagatgagatgttcacttaaatatacaccctcagtacctccactgaaaggatatttttcactaggattctaagggcccagcactcaccagaatgggaaggcaaatacattagaacccagattggcaagtgcctggaacagaacctgaattcgagactgctagctggaatgggaccttagggataaagtgacccagccctgtccattagttgatgagataatgaagcctggagtggctgaggaacttctctaagatcacacagctccttgctccacatcacacagaggcagcacatggcttctctgactcctacttctgtattcttttgggtacaccatctattccagaacaatcttttatgatggggagtgagtcaactcacattctttctgtagttgtgtgcaaatgagcttctactgttattgattcattatttaaatccaattaatcacaatagctatacttctcatgcactactatgtatctggaagccttcagacatctcctcgttctcctctcagtcttgcagcataggaaatattcgtgttatagatgaggaaactggggcttggggaggataaaacatgctcgtgttcacacattctctggagccagatgacttgagttgtaatttggccaccaccttcctgccttcattcctagctgtgtggttttgggctagttcctttaacctttccatgcctcagtttcctctcctgtaaattagggagaataatagtagctgttgtcgggtagttgtgaagacggaatgagataacatatgtgccaggcacagtgtaaacccttggtaagtggtaactattatttttacgagtttttgagtaatggggcaaagattcaaacccaggactgcaggcctccaaagtccaagctcttttgatctcgccaatttgccccctagttgttaagcttctagggcacaatgaaccactatatttttcttccaatagaatagtccttagcaaactgaatcatggtgatatctgcaaaaccttgtttgcatagaatagggaatgggactctggggggacacactgggtctagtcacagcctggcttctgggtgccctgggggagagcagtgcaaactggaaggtaagagccagtgtagcatcaagggatggatgggcagccatgcccagaggtctcttctttgcacagtgtcaccattcatcaacattcggaagaattaatagtcattccttaaaaactagttgtggccaattattttgttctgccccaagagcaaaaaggattctatatctacactttgaatcttattgctcaggaactgtcttacttctcaagaaatatccttggtaatttaagaaataaataaatgtagtaaatgacaaaatatggaaacaataatgtggacagacagggtgtgtgtgtttcagccaacacaagagcagtctaaagcaggccagccaaagtgccttgacacacccaactttggtccataccagctgaaaatcaggctccatactgcaaaacttattttagttataaaatgttggtgtttgcttttcccatgtttaggtagaggtcaagccattgaatcttttaaatatttaaatatgcaaaatgtgtgtagtagattgacttcttagcttaagtggagtcattccacaggaaatttatcacttgattaattgccttaatagcagccatattttaaaataacttaccaggaaatctggttaggtagtacagtattgagtggtagcaatttttttaatcctaaatttactgtgggaagatttgctaggcatcactgtaacagaatggcaccagcgtgccaatatatttcatgattgtaattcggcaagttatttaaaatgttttctagaatgctctggctgaaaaatttttaaagtagtatttcttgtattttggtctggttcctaatcttatttctataatattccataagtagttagcaagctttgcaatcacgggtctcaggttcactcatcttgggttcttttcctacaattctctgattaaattttatactcactgagcgcttatgggacatgcagatttaactacaacttggtctgctagtgtgttttctacttcttttcgtaattatatctcaaaagttttaattctttaaaatttgacaaataatcgtttcaaaatattgatttaatttttttttctcctgcagctaaattatctgttgtcagttttgccccctcctccaatggtactccaggcaagattttgaaaaaatttaaacctagatttagtccaatttgttaaagttttgttttaattatatctttgtattgtttttctcctcgggacaaaaagaggttgaaacaacaagcctcaatggtaagaatttttctgaagcaagtgaaaattgataacccttaatatgaatataagtataatgaatggtgttgaaggtttccatttctaaattatttctgaatacgtcgagtagtttcaaataacccaaaacaaaacttgccaaccctggagagtgacctaaactttctggttaaatgataacattcttacagtcatggagggaagagagcagtccaccactctaattgttagctaaaaataaaagaaatatcgatcacattttgaattatccattcccttgctgtccaacacaatgccaacaagttttacatgacagattgtttaaatgtgaaaagcacatccagttattcaatatgattcagcatggatttggaggcacagtgtgttcaaagacagcctttttacagatgatttgatcaatttttaaatagtatgaaatgggaaaaaaatggcttccctatcatgctagagaaaagggcaaagaagtgggctttattcaagggaagggggcagagcagtacattctgttccctccaataagtgaacagaatgggtagacagccttccttccatcttattgcgatgaaaccccaacacttttcacaagcccttggttaaaatcaaatctcaccatatggttggtggctaaggagctaaacaatcatagatgcagcttatactgatcaaaactggtttaaattcatatttggcccaatgggaagggacagatgttatcatttttatgtgcagttacttctcacagtgaaaataatatcttcaatttagctttggtgcagtttttggatcccattttgtgtgtgtgtgtgtgtgtgtgtgtgtgtgtgtgtgttttaagtatgatgtaataaatgccttttggttttttcctaaaatttcatccagaatcataaattctagaatgatttggatttaaagaaatgccaatagaatcgattttaaattggattttaaatcaaacaggatccaaatgagattttcttaaaagttagtcgaatataatggtcatttactccaaatttaagctagaattattttaaattgctttataagagtgtaccactggtaaaaatgtattatgcatccacagggctatatattaaaatcagtattaatgttggaaatgtcatatcccttagggacgttcattataatagagaaaaaagggacaaaatattaaacaacatagatgagtttattcaaatctaatggttacgggagtgttgctaagtgtttagacatgtaacttgcatttgaatcaatgaacatttgctccggaattgtctccaggggttggagaatggagtagtgagaggatgggtagcaaaaacatttagtagtgtcagttggcttttgcaaaactaacttctcccagatttggggaaaagggaaatgtttaaggaacctaggaagacacacatgtttgtaaaccatgccagtagttatgctaatttttattattttatttcagatgttactttaagcttactcccttcaaacgaaacaggtaatatcaagtgatttctaaatgtaatagcttcttctgcagcctcttgagtgtcttgcttgtgcagtctactgggttactaaagagttttcttttgcctccttgccctttttcctgtgccttcaaccattgatttatgacccctttgactttgacattgaactataattctgtcaccacactcccaaacttccaaaggatggccatagcactccatttaaaatagcatgtattatttttgtgattataatagtgatacatattagctcataaagatggagaatatagagaaatgcaaagaagaaaatacaaatcatctttaatgttactttcctaagactatgactgttaacaatttggtctatttccattcagtatcatttatacatatatttatatacatatactcttatatcctttgcaaaatagtcataatttacatagatttttgtatcttgcccatttgacttaatattacgttagaagtatattccagtgtcccttactattatgacttgataatattccattttgtaccatatgttgaactttaaagttgtttctatctttttaatagaagttattgcaatgaacattctggtgccaacatctttgcattcatttcttatttctgtaagatacattctaaggattgcagtatgcaaggattgcattctaagggtcagcagtatgaatattgtaagactcttgatactactgcttggttaccttctagaaaggtcgtgcctagcgacattcctgtccgcagtggatgagaatgtctgtcactgtacctttgctgagactgtatcatatcttattaaatctttctctcaacgcttaggttttatttttcattcatgattactagtgaagttaaacatttttaccccagagcactttagttaccaaaaccagaagttcatttcacagttgtattttgtttgctctgaaaaggaaactatcagggcaaacaaaataatatatttaaaagatttttttttttttgagacggagtctctctctgtcatccaggctggagtgcagtggcgccttcttggctcactgcaagctccgcctcccgggttcacgccattctcctgccttagcctcccgagtagctgggactacaggtgcccgccaccacgcctggctaattttttgtatttttagtagagatggggtttcactgtgttagccaggatagtctcgatctcctgaccttgtgatccgcccgcctcagcctcccaaagtgctgggattacaggcgtgagccacggcacccggacctaaaagattcttaatgacaatgtgaaatgctatcagccttcataattaccacccatcattggctcatgggtcacacattgaaacctgacagtttcagaaacctcatttgtgtgtctttgttactgatgagtttctgccaggataacatcatcattcttaagtgtgtttccaatctctgagcttggccttttcttcagaatttgcccatccaccctaggtgacagagcttcggtgaaaatctatgccctgaacacagcctctttccattggccatttttacagcaaagatttctgtacctgcttctccgttacctggggaatgaaccatgggctctgtccccaaaacgtgtttggaagacatttctaaagtttgcttcttcagggcatgttaatatttgcctgtgagtcactcactttgaacagtcttggttctgctgtgggcgtgttatgtgattgtgtataggtggatgatctcgacctctctgagaatagcattctctatcagtacaatggggatagtattatgttaactcctaaagaagatagcgagacacttgattgtataatagcaatactttacatcccatgtgtactgtttcacattaatttttattctgaattacctgtttttacaacctatcacctgaaggtcccgatagtggcttaattctacatatctgaagtgtaagtccacatcatttgtctagcagcagtgtgtggaaagtaaagtagaattacacaggcagtggggtgtgtaatgggtgtgatctaactgcgtaaacatggaactccaactcccagactcaccctgtgccaatgctacatgatccgtggatgcggttcctattcattctgctgctgagatgaccgatagtgtcttaaaggtgtcaacagtgtgactttttttttagcacttcactaaaatgatactcatggcaaattgtttttaaaaaacaagcaatgattattctctaatatttaagttgtttctttgcagaaaaaactaaaatcactatagtaaaaaccttcaatgcatcaggtatgacttattatcaatatcaagactttcctttttataactaaagtaaaattaaacaaatggctggtgtttataatttctttctcttttttccaaacttttcaagataaaatctggtcttaacaaacagatgtgtatgcactgggtacctgaaattgtactaggtgtttggggctatataataatgatcagacacagagcctaccctcaagaatcttctagtctatgggtggagacaaggcaaaaaaatagataactaacatgaacatgcatgcagataaaggcaatgattatacaagtattactgacatggttaagaggcataggagtagagggggatgcaattaatgaagaagttagaggaatgaacctcaaatttttttttcctgagacaagatctcactcagtggcccaggctacagtgcagtgatgcaatcatagctcactgcagcctcaacctccttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcactaactcaaattataattttagtttgtacccaaactagttttctcatagaaaagaatttaaggatttgtaatgtgcaatggaaataaacttgcagttgggcattgcacacataattctgaccaaacaagacctaacaaggagacaaaaatatttcttaatataacaagtttttcccttggcagtttgtttaatacattatcagcatttgctcctcccatgtactatggatttcttatgctttgccaaaaggatgcaattaataaaggaaggctttttagagaagtaaaccttgagttcttttcaaattgaagaagagatacacttctcctctcaccaaaggagaaagtgtttctcaggttaatacgtataaagttttggttctgatgctcattttatctcccagtcatctctgtctcctttgtatgcctgtgtggtctgttgtcctggtcatcactccattttgccctcactaataagtaaattaaaaaatgctttttatttactggctagtatcatccactagattgtatgctccttgagggcaggatctatatctggaaactcccaaagcctgtagaatatggttaatgctcagcaaatatgttttgaattttgtagtttttgcccatgaaacaatattatgacattaatgttatttcatacatacatttgcataaagagctaggattaacattagagtgttcatagactcccctacataggaaaagaaggaggatctatgattaagggccattccatttaaagtctctacttggtttgtgttcatggtgctctgtttatactgaacaggagagggattaattgggaaggggtcaaaaattttagggaggagttaaggatcagatattgacatactaaagattagtaaagaattaagttccgtagctgacaaatgaccaacaaatgaaaactcatttctttagtctttgtggaattcatccatccaattaattccagcttataatatttctggtccacatttgatgcctacgtttatgaattctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctccttaaaaaaaaaaaaaaaaaaatcaccatgctagctaaggagttttagaattttgggagtaaagaaggctttcaattttagggaaaatgcagttttctgcagtatgaagtttccacttggaccactgccttaaaccagtggtttgaaatcttagctgcacattagaatcacctggggagcattaaaaacactgactcccaagactcaccaactaaatgttttgtcattttaaaaacatgtttgacggtctgataggtgagaaatggtagctcagtgttactttaatcaacatttccttactaaggcagagtctgaacattttttcatatatttgggggctgttttgtatctttttgtgaattacatgtacatgtcttttctgtattttttctaattgatatctgatccattatttaagagtactttagccgggcacggtggcttacgcctgtaatcccagcactttgggaggccaaggtgggcggatcacgaggtcaggagatcgagaccatcccggctaacacggtgaaaccccagctctactaaaaatacaaaaaaaaattagccgggcatggtggcgggcgcctgtagtcccagctactcaggaggctgaggcaggagaatggcatgaacctgggaggcggagcttgcagtgagccgaggttgcgccactgctctccagcctgggtgaaagtgcaagactccgtctcaaaaaaaaaagtacttcatatattgtgcatattagctctttatatgcatatctatggtatatgttgcaaatattttctcccagtattttagttgtcttttgactttatcatgttttttgtcatggaaattttgaaacaattttatgtagttaaatacgaaaaagttcatcttttccccagtgatctgagatgtcacctttgtcttatactaaattttgatagacatttgggtctaattctggatgttagatgttaacactgggtgaccaagctgcgtgggaggtatacagagctgtttgtattgtttttatagtatttctgtaaacctaaaattagttccaataaaaagttaaaaaaaaatactgattcccagtcaccaggctcagagattctgatttaattggcctgggatatagcctaggcattaaggcccttctggaccaggcaaggtagctcacgcctgtaatctcagcactttggaaggcccaggtaggagaactgcttgagctcaagagttcaagatcagcctgggtgagatctcatttctactaaaaaattaaaaaaaaacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggaggacaggaatgaaaatgttcactgtggttccccatgagtgacctgcctgctggcattatgagttttgtttgttttttttttttactttttcttttctttcttactttgcagcattttctatattcttctacaatcagataaaaattgtatttggaaaaaaaggacttaaaaaaatctgtgtagcttctcagatgggaagagaaggctaagtgtagcctgtctgccctttgtgggccagatttctgggatatactaatattaaaacgttggaccttgaggaacaggtaaaagtctttggttaaggatttgtagcaggattttctgcaatagaaagtaaagagtaacatgccccattcagcttcacatgccccattaagctggagcattgagccccattttggggatagagtttctggaagcattgggatcggatcagaagagcatccctcttttgacgcagccccactgacccctagtggctgcccctagtggttaagaagaagaaacaggaatagaaaaggggtcaggatgtgaaactgatgtccagttagggctcagtcattaactagctgtgtatccgtgttccagagcagatgcttttttaccttcagcatctcagatcaaatgaagaagtgagttagagctctgtaaaattaggaaatggactggatcaacacttctcaaatatcaccgtgcacatccatcactcaggatcttgttaaaatgcagattctgatccagtaaggcctgggcctgaaagtctgcatttctgacaagctcctcaggtgaagccagtgttgctggttcatggaccccactttgagcaccgagggtctgtatagagactgtagagcagtgctagtggttctcaatcctggctgcatgttgaaatcctctggagcgttttaaaaacattgatgcagctgggcatggtggctcacgcctgtaatctcagcactttgggaggccgaggtgggaggattgcttgaggccaggagttcgcgaccagccagggcaacatagtgagaccctgtctctacaaacagtttttaaaaattagccgggcagggtgatgtacacctgtagtcccagctgcttgggagactgaggtaggaggggtcacttgagcctggggagtggaggctgcagtgagtcatgatcatgtcactgcattccagcctgggtgataaagcaagaccctgtctctgaatgaatgaatgaatgaatttaaaaatacatcgatgggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaataaataataaaaaataaaaaataaaaacaaaaatacatcgatgcctgcctcccaccctcagagactggtgtaggatgtggcctgggcttcccagtttttaaaaactcctgggtggggtggttctaatgtgcagccaagttcgagaaccactgggctagaattagatgcccacccagggtctttctaatatgttggttcttaggtttaactgtacattagaaatacctggggtatttttaaaacatactgatgtgtcaaggtggccttctagggtgctggaaatgctctgctttgatctaggtggtgattatatataaaattcgtcaagctctaaatctaagattagtacactttatgcaggctacaccgcagtaaagaagcacattaaaatgccatgcattaaaatgggcactgcgcccaccgccagaggttccaggtcagctggtttggagtgggagcccaggcatcggtgccgaggtactctgaggggttcagatgtactgctggcattgcccaccactgctctgccgcttccctgtgtgcctcacagtggatggagggctctgactagcataaatgacaggagtagaaggcaacctcttcacagttgagcccagtgaacggggccttctgaaggcccccagataagctgaagaaaatttaatgtatactttgcaaagcacctttaccccaacttggccaggtgggttgctacagtgtacagtttagggaatggagcctgagagatgttgggtaaattgtccacaggagtagtgaaagctggagccctagtgaaggttgtttgttcgtttgtttgtttgtttctgagacagagtttcgctctttcacccagactggagtgcagtggtacaatcttggctcactgcaacctccgctacccgggttcaagtgattcccctgcctcagcctcccgagtagctgggattataggcacccgccaccacgcctggctaatttttgtatttttagtagagacagggtttcgccatgttggccaggctggtcgcaaactcctgaccacaggtgatccactgcttcggtctcccaaagtgttgggattacaggcgtgagccatcgtgcccagccaagtctaggctttttgactcatgatgtttctgactgtctgacaccctttatcctcactgccccgaacctcaggggatgcagggaggcctgtggccaagtgaccagccagactggaccaagcaggcttttctttttatagatgtgacttgctttaggccccttgacctaatattcctccctcttctcaccctagagaagctctaagaacacattcttgttggtgttctaagtctccatctgacactagatcgatcagaggcttccttgagtaaatattccctgggtaataatttgttgctcctcctctagttgttcctccctagatctctcaagactgatggatcttgtgccagagagtaggtgaggacttctccacctttgatgcccatgaaaatcaccagagagtttagaaaatacatatgccccatcccaagaccagctgaatcaaacacagaggagtgggccatagaaatctatatacacatatgttttaaaaagtgttctgggccaggcacagtggctcacgcctgtagtcccagcactttgggaggctgaggcgggcagatcatcggaggtcaggagttcgagaccagcctggccaacatagcaaaaccccatctctactaaaaatacaaaaagtagccgggcatggtggcaggtgcctgtagtcccagctactcaggaggctgaggcaagagaatcacttgaacccaggaggcggaggttgcagtgacccaaaatcacgccactgcaccccagcctgggtgacgagtgagactctgtctcaaaaaaaaatgttctgggtagttctcatgcacagccaaggttgagaaccactgagctaaaggaaccttgaagacacagctgctgtagaccacctcttttgccccagcttgattcattgttttcattcaaccaacatttcttggtcagttaccatgggtcagctaccactatgccaggctatagcagtgtaaagttgattaagacagattcctagtatatgaaaaccagttgggtcacgagacatttcgcagttcccctcacccgggagcacagagaagattccctcaattgagtgaccatgagacacagagccacagagcagcagtgaactggggagtcacagaagagcatctctccttgcccattcctctcccaggaagtaggtggtagaagtgggcaggggctgggggatagtggcaggtgcacagagggtgtgaaatggcagaggctggaagtgtcatgtccctgatgtaactacgtcaacttgacggtgtcagatgattgccagaggggaaagacttgccccctctgtagctcattcgtgtctcacatgtatctctctgatttgttcctttagtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacaggtaaatgtcacttgaacagcggccaatctgccaatcaagacatctatgataagaccatgttgagcctttctttgtatgatgttcgcttgatttctagagctttcctttcgggattctaacgttctaatgacttacatggttgcataagagtcattgtgttgaggtggcatatctaatttaatcaatatctaatttaatcattcctctcttctgaaaccattaagtttattctactttttagctcccaggtatcggtatctttcatgcagttgtcactttgcttcttggctgtggctgagttccattgttttgaccaagataatggagaaatagctctaaagggcaagcacagatctcatttgatggagttggagattttctaggtttctttctcctacaaaagttggttggaacactgttttcaacaccctgaagagtaaacttttgatctattaaacatagcagctcagcttagacagaagacaaaagaaaaaattggcaggtctgaaaatcagtcagtcacagagtgacagagctgggactgagccaaggtagtggtaggaggggagaaacactgtgaagacccaggcttgggtccgcacgggccctcgcagacagtgtaatctggaacaagctccttctgcctccgcctgttctatgcgaggatcaaaatcatcacactaactgcatgaggctgagaatgaaggtgtacgtgagaatgctgtggaaaccgccaaggcctccagggtccaaagtgggcttagtggtacagagataaaggcaagagggaaagaagctgagagaaatctggatacactgaagtttcagttccatgagtaagaggcaggtcttcctctagaatttggaggatgggggaggcaaagccaagtttttggtgacattagattgattttggtacccacctcctccaccctggtgccagcatcaccaggagatgaggagcttctgccaaatgacttcatatttcttcaaatttgcactgctctctcttcagtaaagttttttaaattgtttctttttttttttttttttttggtagctttggggtcttgctatgttgcctaggctggttttaaactcctgggctcaagtgatcctcccacctcaacctcccaaagcgttgggattataggtgtgaaccattgtgcccagccaataattttttataaatgtaaatattttcagccaaattagaaaagcattggggctgtagtcaaaggaaggtccaatggctgatgaagaatacagtaaaattgaagttcattagcctgggcctaagatgcccaccttcccaaagctaattcccagtgatccctagactcagcctaacaggctacacaaaacactatcaaggtggcctctggtgcctatgtattcctggggcaacaagaagcaaagtgacatattcataaaagatacagattgaggtgttacccaggagctaaaaattagaataaacgtaatggttccagaagacaggaatgattaaataagatatgctactgtaacacaatgactattatgcgaccatgtaagtcattagaacagaaacagaaatatacagaaacttgggggcattttcaagtcttgatgtgaggtgaaaatagcccaacaacaaatagtttgcacaccatgtttataacagtgtaaatacacatgcataaagatttgacgggaataggcaaaataataggatgttaagtggtgaaattaagagttgtctgttgttaaagacaggtttgtatcattgtttccctattaaaaatcagacttacaggtgatagtccagctttcataatattcttttttgttttgagagagagagagagtctcactctgtcacccaggctggagtgcagtggcgcaatttcggctcaccgcaacctctgcctcctgggttcaagcgattcttgtgcctcagcctcccgagtaactgggactacaggcacatgccaccacacgtggctaattttttaaatatttttagtagagacagggttcccccatgttggccaggctggtctagaactcctgacctcaggtgatccacctgcctcagagcctcccaaagtgctgggattacaggcgcgagccaccgtgcccagcccataatattctctttttcacaaaagagcttccagcaatccacataaaatcctgtacacatgatacaaattaaatacaagtatacttgtgcttatatgagtatatactaaatacactgatgtgctttatattttttagatttattgaagtaaaatttgcatacagtaaaatgtatccaattttatggataaatcaaatttttgcagttctgtgcagctagaaacacccacagtcacgtaaccaccatcataatcaagatacataagtttcccactactcccaaagttcccttgtgtcccttcgaagtcaaaacctaatcccctcacccccagcccctggccaccactgatctgtttccatacaggtttttggatatttctagaatatcatatgaagagactcacttagtatgtggccttctgagtttggcttctttcacttagcataatgtattggaaaactggagatccacccatgccattgtgtgtatttagagttaattcctttttattgctgaataatatttcactgtatggaggtaccatagtttgttgatccattctccagttcatggacattcgggttgtttctagtttgggactattatgaaaaaggccactataaacattcatgaacaagtcttcctaagacatatgtttgtatttatctggggcaaatacccaggagtgagtttgccatatcacagggtctatgtacgtttatctttattagtgggttttccattgtgtgttcataacacgatttggctctttgatatagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaaggtacgacttcgcaaactgaagtggtggtaagaggggaccctccaaagataaagatgctgctcacatgattaatatcaccaagtcttttactcccaagtaccaggtacatcatggtttctcaggttgctactctatattctgcttagaatgaggagacagatgggactgccaaatctacactaccaaccttgaggccagacattgtggctcatgcctataatcccaccactctgggaggctgaggtgggcggatcgcttgaggtcaggggtttgagactagcctggctaacatggtgaaaccccgtctctactaaaaatacaaagattagccaggcatggtgatgcgtgcctgtagtcccagctactcaggaggctgaggcaggagaatcacttgaacccaggaggtggaggttgcagtgagccaagatggcaccactgtactccagcctgggaggcagagtgagactctgtctcaaaaaaaaaaaaaaacaaaaacaaaaacaaggctgggcgcgatggctcacgcctgtaatcccaacattttgggaggccgaggcgtgtggatcacgaggtcaggagatcgagaccatcctggccaacatggtgaaaccccgtctctactaaaatacaaaaaattagctgggtgtggtggtgtgcatctgtagtcccagctacttgagaggctgaggtagtagaattgcttgaacccaggaggcagaggttgcagtgagccgagatcacgccactgcaccccagcctggcaacagagcgagactccgtctcaaaataaataaataaataaataataaactgccaacctttctttacagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtacatcataattgatggcagaaaaaaacattctcttgtgtgtgattgtagtccccattgtatttcatgattgaggcaattactgcttatagtcaggggtgatattcaaaatatttggcatctagaacagtgaggcaccatagaatcaagccgggtgccatggctcacacctgtaatcccagcactttgggaggccaaggcaagtggatcactggaggtcaggagttcaagaccagcctggacaacatggtgaaaccccatctctactaaaaatacaaaaattagccgggcgtggtggcatccacttgtaatcccaactactcaggaggctgaggcaggagaattgcttgaactcgggaggcagaggttgcagtgagccaagattgcaccactgcactccagcctgagcgacagagtaatattccgtctcaaaaaaaaaaaaaaagacgttggtcttggctggtacaggatgtcagaggtcccccttacaccttgcgttaaccctttagcagctgaattttggaatgtggcatgggtggtatccagcagagggttctaggcaattgggagagtaggcaggggtgtcagctacttaacatcacatttcgatattataacaagtgttagaactgcactgctgtatatagtggtgctgagtatcattcctgtttctagtgttttctgtccacctatttagagggattgggggctacaaacacccaaggaaaccaagtctcgctttttaattttcatagtcttccctttacaagtgtactgcacatggttctatgaggacttgactctaactggtcactaacttggtgtgtctgctgctacagtctccctggggtctgcagtcatcttgcacttttcaactatttctttgcatccttaaaatgtttcctttccttcttggaggcctcctctccttattacacttccttttttttctttttttttgagatggagtctcgctctgtcacccagggttgagtgcattggtgcgatcttggctcactgcagcctccgcctcccgggttcaagatactcccctgcctcagtctcccaggtagctaggattacaggcgcctgccaccacacccggctaatttttgtatttttagtagagacagggctgcgccatgttggccaggctggtcttaaactcctgacctcaggtgatcctcccgactcggcctcccaaagtgttgggattacaggtgtgagccgccgtgcccagcctatacttcctttctttaatttagtagcaaccagaggaatagaagtagaagctattttgcatagagatgccgcaggtcaggtccttacagaaccctgcgttttaattattaggctggtgcaaaagtaattgtggtttttatctttttttaaaaaaaaaatggcacatactgcaattacttttgcaccaacttaatagatgtgttttccatctcattatactagctccagacatttattcttatcttccacttgattttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgccaagcactatcctaagcagttacaaatgttaactctaatcctctcaacaaccctgagaggaaggaactattattatcccattttacagatgaagccatggaggcgcagagagacgttaagtgacttgcttggggacacacggcttaaatggcttaatgctatgttctctttaaagattcacaaaatcctgttgtgtcaatctgtgcgctttagctcagtatttagagcattgtattgtagaacaagctctgtttctctgattgtgatcccttgggaaagtcactttcctccttgtccctcgatttctgacctatattgtaagataaacaatgtggactgaatattccttagtgttccttctagctctaaaactctgacaatatctcatttacccttgccatcttgatgtgccaggatccttccctggagaacctctctctgatcagctacgtcatatcatcgagtgttgcaaacctgaccgtcaggaacttgacaagaaacgtgacagtcacattaaagcacatcaacccgagccaggtggggagaggccagtgccgtctgttcattgaccaggaacaccttgtacaaactatgcttgtaaggcatggccggcaaaaggcagatcaggcagaaagaaccttcagctcagctggagtagtttgcaggactagaatcacatctctccattggattttaacacacttaataattgaccagggcaggtgcagtggttcatgctgtcatcccagcactttgagaggctgaggcgggcagattgtctgagctcaggagtttgagaccagcctgggcaacatggcaaaaccccatctttgcaaaagatacaaaaattagctgggcgtggtggcaggctcctgtaattccagctacttggagggctgaggcgggaggatcacgagcccgggagctcaaggctgcagtgagctatgttggggccactgcattccagcttgggtgacaaagtgagaccctgtctcaaaaaaaaaaaaaaaaaaaaaaattgaccacctaatttccaggaagaattggtgcaaaagcaagctcttaacaactgtgaaatatcagatatcagtgtgtgtggatctgtggctgcaggtctgattctcagctcagttcacactaagcatcatctacgacctcactactcacagtgtggtccacagacccacagcatcagcatcacctgggagtttgctagaaatgcagagtctcaggccctaacccagacccactgagtcagaatgtgcattttcacaaggccccaaagtgattcctatgcacgattgatgagcttaagaagtgctggtctatttagggcttacttgcttctagggaccatataaaataagaactctctaaaaattaagcctaagattctgaaatttaaaaaaaaccacagttttttttcttttcaaatacctttcagttttgctttttttttttttagttcagtaaattaattatgtgtgatttatctttctaccacaggatgagttaacagtgagatgtgtattttgggacttgggcagaaatggtaagttccagtcataaccttttcaaactcttgagtgggttaattggggagggtgtgaagtcactggtgctgtggccttgctgatgggacagatgttcttcccaatgccaacaggtggcagaggaggctggtcagacaatggctgctctgtcaaagacaggagattgaatgaaaccatctgtacctgtagccatctaacaagcttcggcgttctgctggtaatatgcctgtgccacgtggccttaaattctgagtctgaggggtagctgggcatcacactacaatgtctaatctgatggatggataaccgtgacagatcagcagatatgatattgtggctgatttatacaccaatgagattgctctttgctgggcatggtggctcacgcctgtaatcccagcactttgggaggccaaggtgggtggatcacttgaggtcaggagttcgagaccagcctggccaacatggcgaaaccccgtctctactaaaaatacaaaattagctgggtgtggtggtgcgtacctgtagtcccagctactcaggaggctgaggcaggataatcgcttgatcctgggaggcagaggttgcagtaagccgaaatcacaccattgtactccagtctgggcaacagagagagacgccatctcaaaaaaaaaaaaaaaaagagagagagattcctcttctaataagcaaatgcacctgaaggaaaatacctgaacatgaaagacaagtattttttcacattctctttttacatttaagtttttctcttttaaataattaagagaactaaggaattcagattaggatgagtaataaaaattgtttagtttgcaatgcactttaagatttttacaaaacactttgacataaatgctcttatttaatcatcccaacagtcctgcaagataggtagaatggggagttgctattgtcattttattaaaatcagaattaagactctcttgttagatagttgcccacagtcatagaactaagaaatgtaagaggcaggagctaaattgcagtctttaggctcctagtccagttcctttccattgcactataatgcagtgatcaagtatgtgggctttggagtgtgccagacctgaatttgaatcttggcttctccactttctatctgtgtgtccttgagcaagttacttaacctctctgtgtctgtctctgtttccttatctttacctgatagtaataattgtgcctacctcataggtttgttgaatagactatgaatggatccctagaatacttgatacatcataagtcttgtatttatttaaaaatatttgattattaaaagcaatatttcattttccaggacctatctaggacatctgtgctgcctgctcaaatgatggctctgacgttcattacatatattggttgtgggctttcatcaatttttctgtcagtgactcttgtaacctacatagcttttgagtgagtatccacaaccggaaatttggatttaggactcagcactcacctccattgccaacatttattaactaagccctttcctcggcctgccttaccctgtacacccagctagtggagcatccatgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaatagatattcagtgagtgtagctctgcagcaagaatgccattctaaaaaacagcctttccttcttggcttaccagacaggtccctttggttgctttttgggggtaattccaacaaattctaatggaaaagaaggacatgggcatttttattgcattaacgaatcgaaacaatatgtaggttcttggatttagattttggacactgatcaggaaatgtaaaaatttattttcagtgccaaagttagggtctagctgtgactacggatcttctagtgagcctttggaaatattattagtgagactaaataaccagaaggccagccattactcagaatgatttcatcggatctaattttgcatgcataaacatgaacatgtcatcaattagctggcttctcctatgctattacatttagctgtagtttaaactcttctttccatgatctcattttacctaataacatacaataatatgggaatcttggttaaattttgaagatctgaatatagcagactccatgagaagcagcaccaatgcttccgaaagtagtctgggagaaatagggcgagtgcttagtagagtctactacaaactatttaaaagtatgcgtcaacagtcagcatgtaaaaggtcccacagaaatacagacacaaattctccttatggttatcacagatgattctgtttagatttttcctttgttgttgttggttttaagctcccccccaccccatatacacatatactcaaacagaggaaatttatgcatatagacatttaccaaagaataaaaataaattgcttaaaactcaaagagcctgacagatatgcttacataagggttggtgctaggtgtggtaactcatgcctgtaatcccaacactttgggaagccagggcagcaggattgcttgagcccaggagtttgaggccagcctaggcaacatggcgaaaccgtgtctctacaaaaaaaataagggtgtggtagagagcgcctgtagtcccagccactcaggagactgaggtgggaagatcgcttgagcccaggaggcagaggttgcagtgacctgagatcacgctactgcactccagcctgggtgacagagccagaccttatcttaaaccaaaaaaaagttggagggttggcagagtagaatgctcattcttgttctcatcctttccttttagaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggtatgtataagcttgcctgcatgttgcctggactttctctgccttttctctagtgttttgatttttgagcaggtggaaacgatgaagcagatcacattcagcaagtttctaaaacagctttatactcttacatgtgcactgcccgaagagcaactttgtcaagtctccttctaggacacctgtttatttctttggatttgttatgaatatggaattcctcaaggttgaaccatgaatcctctttgtatctccaggaactagaatttggggctggcacagaaggtgctcaatatattgaaaacattagcttggggtggtaatatattgaaaacattagcttggtggtaaagagcccaaactctcagtccctgagctcccagccagcctcattctactttgtacctcccagatatcagacacgtatgacagtatgctaagaagggcagagtgagagaatgtacatataaaacccattgtaacttcactgccacgtgggcatgacatttcagattgtgcagcctattggtggcaggtcgcaaggccttaggctccccaaatatgttgaagatttcttcattcaatttcccacccaatgcaggagcctcttcaaccctcaactccacctgacttatccttgactaaagataatctaacttctgcttgaatacttctattactggggagttcatgaccttacaaggcagccaataaccattttataaagctctacagttctgattttccattaagttcagttggctccctggtggcacttaccagtggttttgctcaggcagaaaacagtaagttgatacctcttctgccagagagtcctttagataatctacaagtaatatataacagtgtgtataatcccctgtttttcacacaagtgaccccatgcaagataagccagtgaggtgagccaggcagtcatcccaaatgtaggtgaagaaactggctccaagtgatgatgtgatatccccccaattcacaaagctagaaaacagcaagcctggctctccgtctccttatatgcagccttctgccatccccccaaccagactgcctctattttcaggctaaatattcctacacatcaagattgaaagcacaccaccacccttgccaccctgccttctatcttatgtcactatgtctttgtgaagaacaacagaacaacaccctttccctgtttgtcccagaaacataagtcaacgctccagatactgggcacggattctgtcttctttagagaaggctgaaagtcagattcctttcttaagtatgaggcccccacccccaatgttttatttttaacaaagtgtctcacttagaaaattatcatatgtcagggtcaccagaaggtacaagcgcaaaggcattaaatgaactattagatttgattttaccaggcactgcaactggtctgtgacaaggaattgtttgttctttaccagagccttgagataggacgtctgctggtcagtgtgcagagtgtggggcggtggcatggggctggcgggtgatggtgtgcagtggtgaataggattctttccccaccaaaagccattttaaacttgggggacccttctcatggtaccttctctgaagggaagtgtccgtgggctctcaacagagccagcatagtagcagtcaccaccccctggatcagccaggacagaaccctccatccttcactgggtctcaaagtcttcaaattgaggacttttggtttcataatgaaagatttgccaggagttgctgactcttaaatatacattccagacatgtataagttaaaggcacaacgctgggtgcagtggctcatgcctgtaatcccagcactttgggaggccgaggtgggcggatcacctgaggtcaggagttcgagaccagcctagccaacatggtgaaaccccgtctctactaaaaatacaaaaattagccaggtgtggtggtgcacacctgtaatcccagctacttgggaggctgaggcacaagaatcgcttgaacccgggaggcggaggcggaggttgcagtgagccgagattgtgccactgcactctagcctgggtgacagaggggggccgggtggggggtggggagttaaaggcaacactggcagctgtaacagattcaccttgaaatctcagtagaagatcatttctcactcacctacagtctagttagcaggggcagaggagtccctggtcttgcagttattcagggatccaagctattgaagactctgcctcaaggttgccctaagtttgcaggcaaaaagaaagtagaggatctcacaggaggtttctatggggcaggcctggaagtggagcaaatcacttgtgcccgtatcccatgggcccaaagtgagccatgtggccacacacacccagctgcctgggaggctgggagcatccagtcatgtgccaaagaggaaaagaaaccagcctggtgaacagctagccagtctctgctacaagatgtaaataggatgtgatctctagtcttgtcacccactttggttattagaactaggtgtgaccagccgggtgcggtggctcacgcctgcaatcccagcactttgggagaccgaggcgggcagatcacgaggtcaggagatcgagaccatcctggctaacatggtgaaaccccgtctctacgaaaaatacaaaacaaaaattagccaggcatggtggcacgcgcctgtaatcccagctactagggaggctgaggcaggagaatcacttgaacccaggaggcggaggttgcagtgagccgagatcgcaccactgcactccagcctgggtgacagagcaagaatccgtctcaaaaaaaaaaaaaaaaaaaattaggtgtgaccaatgtttcccatcttccaggggtaccagctgtggttgtgaccatcatcctgactatatccccagataactatgggcttggatcctatgggaaattccccaatggttcaccggatgacttgtgagtacaaagccccctaagggaatgctaagtgaactggaaaacggaatgctcctagaaaacggaggatctaatcagcatattgactcctgctatcatcctaataaaacccagcaatacttcacagcagccttcacagtcatatgtaatgagagaagctagctggaaatgccatgctactcttcaagtgatgaattaggagctattctgaaaagaaaaatgaattaggaagaactattttgaaaatattttcattagcctctgataaaatgacattccagttatattaataaagactcatagaacagagttgctaggatttacaggggcaaaatcctgaatgtttaaaaaaaggtctatttttaaaatactttaaatcaccaagtgtcctcaaataaactcttagattattttccctagagctataaatggttgtagagaatagcagttttatcattttttttctcttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagagatgttgggggtttggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaaaaaaaaaaaaaaaaaaaagtactatctgtgaaaccccatgaggtatgcttgtatatgcaaagtagcttatttagtggcttatgatattttcattgaaaaacatatttattattgagagggagtgctttgagatccttggaggaaaggtgcttactaaattcaagaaatggtgtttttttctccttattcatagttgtctccttggagagaccatattgaggggaacctgccaggaacactttttgaaaaagtcaattattcttccttcacttggtttcttttaaaaaaaaaaacttttgtattcaagtagaacatgcagactgtaagcacacataccatgactgtgcctgtgggagctcaccactctcccctcctaggtcagcgatttggagacaatgagaaatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgctgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctgtttctctcctaatgcaaccaatggtcgacttccagggtgacaaatgaatgaagctgtgtaatattcagacatgggtcttgacggtgggcacatataccctactagaagcaaaactgttttgtttgtttgttttttgagatggagtctcgctctgtcacccaggctggagtgcagtggagcgatctcggctcactgcaacctccgcctcccgggttcaagtgatcctcccacttcaccctcctaaagtgctgagattacaggcgtgagccaccaccacgcctggcccctggtatcttaaaatgaaggttttaaagtgaatagattgggggtttttaagtagaaagcagagaacccagaattcatccattcactcagcaaatatttattggcaaaagccttggggagtggcagccatggggctggctggggagccctggcctgccttgactgggcacctgagtgggtgagaggtggagtcccagggccccttcaggtcttcagcttgctctccatgccagcacctggggcaggtcaggaggaggcaggcaggtaggtgagtgcattgctgtactgcctgggtttgagggggagagagagatccaagcaaaggacatggcagtgggctggagaggaggagagtgggaagggaaagatgtgtggaggagatggcatttgacagagcttggaaacggattctaaatagggagggagggagaggcaggagcctaagtccaagctgggatcctgggtggatggcttgtaattccaagatacggaaggccaaggacaggatgtgggaggagacagtgaatttaattgtggaaatgcaaagttatgattccttttatcatataaatattcttaatcttacaaagattttctaaaggcattcattccccgatgccttttgacagcaagctttcctaggactctgaactttttattcaatttgcaaaatttcatgttgcccacagctgccaaaataattattaatatcttttgtgcaaagtgagcttatgacattcagctattagcttggaattcattgtgggttttttttccctccttaggatttttcatattcatcttttactgtgtggccaaagaaaatgtcaggaagcaatggaggcggtatctttgttgtggaaagttacggctggctgaaaattctggtaaagatttacctcactttttctcttcctcttaaatctcaaggaaaagattgtataaattaagatccaaagcaaatccaatctagaaatcagtgaattccagcaaatctggaatttgctcaacagaaaatattgatcgtgaacattagggagaaaaaaaaatctagtgaattaaaaaataattatttctatctgggaattttttgagcaataaaattgatgggctggctgcctcttcaatgaagcaacagtaaaatttttagaattgattttctattgagattatgcttttcatttcccaaagtaatttttaatatttaccttggtaatttttaaaatctcaactcaatcctttctccacaggtcctggttgtcagttgctttatttgttagtaagccagactttgtgtataagctttagcatacatttggttgtaacatacatttgtttattttgaagtgattttcacatatacccggttgggtagtagagcaaatagctcattttttttttttaagaaaatgagaaaaatgaagtactgtttgaaaagctacattccttttgcatgaataccacctttgcagtatctgggcgacacgggagtctgtattcagaaaatggcagtacacatagttcaatcattttcatggagtgaagaacaattagtcattacaacacagactatttgtgttcttgttaagacagtgtgaggctctgaatcactacctaattctatggatatttatagacataatcaaattagcttggcctttagttctaggagaatataggttacttttaaccccacagtcatttgaaggacaaatgtaaataatccaaatgaaaatacatgttatcacaccaactggtggaaggtgacttctccataagatcctgaagtgagaaatcagttgcttaggacttgttacactgtgatctgtctcttgcgtttgagcttcaacatactgccctgtttttctgtaatgcttattctgctgtagactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggtatgtatgtctcaatatagtatttctcaagctagtgtttattttttaaaatagttttatcctttattggcattttggctaagcaaagtgagtaactattaatacatatatgactagtggatcaaaatgtggttcccttacagaagagaaagtttactaatccaaattgatttattatagagcaaatactggaacaacgattttttaagatttggtttttcatagtgggaattgatgatgacctaaaaattttaacattttaaatcctcacttaactattgtccaaagacttcagtattgtgctatttctgtgagagcagtacctaaaatagctgataagactatagcaatttttattacatctatcataatatacatgttcaacattttttttttttgagatggagtctcactcttgttgcccaggctggagtgcaatggtgcaatctcagctcactgcaacctccacctcctgggttccagcaattctgcctcagcctcccgagtagctggaattacaggtgacctacaggtgaccgccacgatgcccagctaatttttgtatttttagtagagacaggtttcaccatgttggccaggctagtctcgagctcctgaccacaagtgatttgcccacctcggcctcccaaagtgctgggattacaggtgtgagccaccgcgcccagccaacacttttaaaccttcctattttttgcttttcatgtttgttaattctttcccacaatgtggctgtcttgtgacagcacccaaatccccatgaatatgtcaaaatactggaagatgacttgtgaccagtattggtgaccatatatgtgaccaatatctgaacagattattgctgccatgcctcctttactcattaattctgacatttctagctaaaacttctgttacattttctttctttcataagaccaggctgttcattactcataaaagcttaccttatctatttttaccttctcttgcttcttaatatatcttttgcattcttataaaaacataagctctgctggtatagtttctccttccatggagaatttgcctgtattcattgttttaggatgttagttcttttcatgactaactcaaataaatttgtgagaaggttcatacatctaccagttttcccgtttcctgaagatgggcagtcctgctggtgtgtctagacttttttttttttttttctttttttttatgacaaggtctcctattgcccaggctggagttcagtggtatgatcacggttcactgcagcctcgacctcccaggctcaagtgatcctcccacctcagccacccgagtagctgggactgtaggagcatgccaccatggctggctaatttttttttttttttaagatgcagtcttgctgtgttgtccaggttggtctcaaactcctgggctcaagtgatcctcccgcctcagcctcccaaagtgctgggattacaggtgtgagccactgtgcccggcctgtctaggcttttaaaataccataggatgcctcaaaatcaaggtttctcaacttcaagcacaattgacattttggggctggataattcttttttgtggaattgcaggacatttagcaggatccctggactctatcaactagagccagtagcaccctgcccccagttatgacaacccaaaatgtccccagacactgccaactgtcccaggggagcggggagaagaagggagcaagattgcccccagttgagaatcactgctgtaaaagatgagaaataactgttgtatagccttagctctttactgtcgataccagaaagcaagctctgggctctacaccaaatagctctatcaggaatgattcaatgtaggtaaacagaggcgaggcagcggggagcacagctggttagtacgttagtgtgagaaagcaaattgaaaggagagacatcaaaggagcgagcagggtcatctggggctctgaatccataaaccagatttgtccatattctcgaaagagctcagagatgaagcctcacctgcctagctctatcaacatgttgtcatcctttgggaaatcagatttcatggaaacagcacattttaccacagttgtttaacacagctgatttgacacagctacttttgatgcttgacggtgaggatgggggtacattttaaggctgccaaaatggctcagtgtttaatatcacataatatgcatgtcagataaccattcctgactcctcagtccttgccccagcatctgggatagatgaggaatggaattggcaatttcaaaaaagaaagctagggctgggcgcagtggctcacacctgtaatcccagcactttgggaggctaagttaggaggatcacctgaggtcaggagttcaagaccagcctggccaacatggaaaaactccatctctaataaaaaatgtgaaaatcaaccagacgtggtggcacacacctgtagtcccagctactcaggaagctgaggcaggagaatcgcttgaacccaggagacagaagttgcagtgagcctagatctcaccactgcactccagcatgggcgacagaacgagactccgtctcaacaacaacaaaaaaagctagaagtttaatgatttattatgccagaccaaattgttcttgcaccaaaatgtcctcaagccgaaatgcctaaatccaaacagctgcctcagacagtcacatgccctatttgatctgtgtcacagatggagctacgttaaccatattcatcacctagtttgcatgaatattacacagttcagttctgagctgccttagagggtggggtaccagcagccatctcatttggtacccaggaccacaaggatcacagtttggaagcaacatcacacgtcaactccattacttctgagctgtgtgaccttggggagagcacttaatttctgaaaccttcgtttcctcatctgcaaaatggggataacagtagtacccaccctgcagggctctaaatgagataataaagtgtcccagtactgttatgatcattgttatcataatcatgtcatgaactatcaaatgggcttattattcagctttgtgtatagtctcccaatggtctaatgatcagaaggatggtgccaagtaactagaggaggccagcacctgtgctcccctataactcagggcctgcttggggtggggaaggcccacgtccaaaccaacagttacccttgagtgcccagctgctccctggcctggactctgaagttggaattggtagtttcctcttgggaatttgtcctgtcctgatttagtcagaggagctggtttaatctacaagagagatgatttcttcttgccatgactgttgtagctggttgctctggtttctctggtacaaagtttcattttataggaacctagggaaccaagaacttcctaagggtacatatggggatctctgttaacattaaccttttgggagaccaaagtattaccttagcttatattatacatatgctgctacttgaagtcaaaacatatccaaccagagttaggaagtgggccttttattaatatattaccttgcttcagattttgactgtttcattaaaaaccaaacaaaaaaaaaactgccatagagaactggtttctgaagcaatctccactttggtatgcttactttgagtggccttagggaagtaatgaaaaataaataaaatatgaacatatatcacaaatgtttttaaaaacatattttacaaatacatctttaagaataaagcaatgtctaagtttgtttgctttttaatgctttctgtggatacttcatgccacccgctttgtgtttccttatacaggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaag

SEQ ID NO: 3174 - DNA, 133328 bp, human
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtaagcgctcggcgccaggacgggtctggccccttggggtcctgagacccagactcgcacagccggccacgggcgctggaggctcgggcgcagcgtctagccccggagggcggcgggccagcgggccggcgggacgaacgcgccttccgcccggctgctgttcctagccggggcccgggaacatcctgaaaggcggaggcgtagctcccagccccggggctagttccccgactgggggagcccgcgcgccgtgggaaaggaggctccaaggggagacgcgcgtctccaaaaccttcggacggagccgtactttccccaacccgcgggaaactgagccacgagcctgactcgcgcgggtggtgtgctagacgccaactcccgggagcccggctccgcgcgcctggtcgggctgcggcggtgctggcggagcgcgaacgcgcccgggccccggacggcttggggcggcaccactcggcgcggccccgaacaggtggccccgggcaccgagggacggagcggcggcccggagccagggggtgagcacgccggggaaggagggggctcgtggtctcggagtgagcgcatttcggcagggactcgagtttcgaggctccgaaacccgataaaaagtgagggggaagaagagagctgacctcccgagagccagacgaagcaggggacaggttttccgtggctgcttcgacagtgacagtctgtactgtgcacgataatcccccagggatcccgttaaaatgagattctgatcccgcaggtctggggtgggggccgagcgtctgcatttctaagaagctcccagtggctgctgatgctgttccatggaccacactttatccggcaggccctacggaagtactttttgtccagcaggctgaaaaccttaggaaaagtgggagattgggagacgaggtcctaagactttacagtatgtatagctttaatacctctttgccacctctacccccaaacgcacgcaaaaacacttgctactataaaggccaagggaaactttcccttcgccccctgaaggttcgcttgaaaaattaactgacaaagacagattgattggagaaaaggcatgcaaatgtattaatgtgtccacggggagagaacaatagagtgattacccccagccccccaatggggtacagaagcatgtagattatcttgaggttacagaaagaaaggggtctcaacgcatggccccaaacaggttatggtggtaaaagaggttgtgagagggggagaagaggaggcttggccagcaaaaatggtctggagatgtcaatgaaacctcacaggtggcagccctcagagagaataaacagtaaatgtttctttcagacctttaaaggggtcagatcctcagttaatttctcttagatctggacaagggaggacctcgataaagcctggctacatccgtgcagattctctacaaatgcaaatcttccgcaccaaggacagctttgcattagctctactggctggctttctaaatacgtcaatatttagaaatatgtcaactatttcaaaatatgtcaaagaaatatattttggggtaaaatgatttgatttccttcactactcatttaatagcgaaatattttacttttcttaccaactttctagccaaatacatgatctgatagcagggctggcttcatggacatgcatcctgcacttggtttaatgctgaaattcttaatttttgaacaaggggcctctccttttcattttgcactgggtcccacaaattatgtagctgatcctaatagtcaccatacgtggaaagagaacccattttttgatcagggtttgagatggtgggtgatggagagtagaggtttattaagggaagactagctagatgttgcagttatctccaatctttctcaactcctctttggctatctgaagagataagtctaagagcatacccaggcatgcatggtgtgacaaaatttattactttattaatatcaacagttaacagtttattaggagcttaattattgatagacaatacaattaagtttgatattgaaataattttgtaagtttattgacaagttgtgtgttattttcaaaggattggggagtctctatttagcatctcataaaattttgcttagttaagatctaagatgagctggacattgcttggtttggcagctttcacagctcaaatgcaaagctggaaaacaaaaagtggccaaattttgtagcttttcaggagtattcttttacagggcctcagcgtgatgccagcccggatcggattcccttctgcttttatcactcccacatctctgcaaggtgactttcattaaaagggggatagagcatatttagctactgaaaaacactgaagaaaggcagggccagcatcagtattttgtctgtgaagaaatcttgcccaaaaaacacagattccaggtgtgtgtatttttctagaaaaaagaaatgttggaaatacagaaaagaaaaagattgtactctaactatggatatgattttgttcagcagagggagaaaaagtcagataagtggcatttcattggcgggtttggcagggaaaggaaagctgctgtgtttttggtaccatgaacagccttccagaaatggcaaagtgagtttgctcaggtgcaaggaagagccagcaaagaagctgattttccatggctgatgtgatcattgtggggactcagagcaggacatcacgacatatgttcttggtgctttgacggctcagatgaaactgaaaaacacatttttccacttttctgcctgagcgtgccaagtcgctttcaaatacacgatccaaactgggaagagtgctattaaattaacaaaaggagggagagggaggtgtttctgtgatgtccatgattcaaaagatagaaaggagggattctgactttagttaaaacctgggagctagtttttatgcttcactgagaaaggttttcctgaccacaagataggaagaaaaaagttcttttaaaatgtttatggtttcaaaaatgtgtaggtatttaatccgcatggaatttattttgggattgtggtgtgaggtggtgggtgatggaacttaaacgggctaacatttggggaaagctatcataaaataaattcccgcaatcaaataaattgtggtaaacactgtcccattttacaaatcgatttaatggattcttcagtctactccatgtttttcaaattgaagtgtaacttattacagtaaaattcactcttttcagtgtacagttctagaagttttgacaaatgtatatagtcatgtaaccaccaccgtatcaggatgtagaagaattctaccactccaaggaattccctgttgactctttgtagtcagcctcccccaactctcagcccctggcaaccactgatttgtttgctgtccctataattttgttcttttcagaatgtcctgtaaaagaacttatgtattctgtaggcttctgagcctggcttctttcacctagcataatgcatttgaggtttatctatgttgcacggatcaatacttcattccttactgttgctgagcagtatcccaaagtttgtttatccactcaccaactattgatgattatgaataaagccaatataaatattcacatatggctttttggatgaatgtaaacttttatttcactcaggtaaacacgtagaagatggctatgttgtatgtgagctttatcaaaaactgataaccgggcacagtggctcgtgcctggattcccagctactcaggaggctaaggtgggaggatcgcttgaggccaggggttcaagaacagcctgggcaacatagcaacattcccgtccctacaaaaaaaattaaaaaattatctgggcatggtagcatgcacctgtagtccttgctactcaggaggctgaggcagacggatctcttcagccggggattttgaggctgcagtgagctatgattgggccactgcactccagcctaggcaataagagtgaaactctgtctcaaaaaagaaaaacaaaaacaaaaagaaattgtatccttttttcccacttcattttctatggtagtgagtaggaaggctatttaattgtttttctgtacatttatcttacattcaagccattttactgaacttttcttagttctaatagtttttcagttgattttcttggattttcaaagtagacagtcaaattgtctgcaaatggcaataatatagggaattttccctccaatatttttacctcattttattttcttgctttagtggctaggcttccctgtaggataatgttgagtagtagttgctactattttaccattaactattgtgcttgccatagggttctggtggctaccttaattatcctcaggatgtttcttttccattgttagcttgctaaaagtctaaaagtttaattttaaaatttcttgttctgcttggaattctttttttttttttcccattgaaagcctaagaggtttaggatcagttagtttgcttcttgactttggaagttcatattttgatctcactggaggagaagttagtgtagcattaagtcaattcattttattttattttatttagatagagtcctgctctgtcaactaggctggagagcagtggtagtaatctcggctcactgcaacctccgcctcctgggttcaggtgattctcctgcctcagcctcctgagtagctgggactatggcggcgcaccaccacacctggctaatttttgtatttttagtagagacggggttttgccatattggccaggctggtctcgaactcctgacctcaagtgatctacccggctcggcctcccaaagtgctgagattacaggcatgagccactgcgcctggtaattcattttatttagatgatgaagaacctacctttggaggtttttttaataatgttcttatttgggggaatgctgggtgtactgaggaagaaagagaatcaagagacagtttataacctactcatgtataaacaaggtagctttttctagtgttcaaactttttttgcccaccattcacaataagtacattttatatttctttttttctttcttttttttaattttttaatttttttttttgagacagagtctcactctgttgcccaggctggagtgcagtggcgcaatctcagctcactgcagcctctgcctcccaggttcaagcagttctctgcctcagcctcccgagtagctgagattgcaggtgcccgccaccacacccgactaattttttttttgtatttttagtagagacgaggtttcaccatcttggccaggttggtcttgaactcctgacctcatgatccacccgcctcggtctcccaaagtgttgggattacgggcgtgagccatcacgcctggccacattttatatttcagctcagtccaaacatacttgtatataatggaaacaaactctcacaaagtctttgtctttctcctgtgtgcaatgtattgatattttcaattatctttcatctgttctatttcattttaaactgatgatcatgattttccaaattgatttgactaccctttcatttgattttttgacccacagtttgaaaaacattgttttgtaaaactgctcatttagtttctaagtccccaaactgctggattatgtccagaaccgattcattttatatcagatcctgctatgatgcaaagtaagttcatttattatgctctgagatcagtgtaactacctatttctctcttgaattactgtgtagcctctaaaccagtctttcagtgtctacttttgaccccacagaatagccaatacatgcagtcttataagtccatgactcaaactcctctaatgacctcttcccacactttttttttttttttttttttttttgagacggaatctctgttgctgaggctggactgcagtggcgcgatcttggctcactgtaacctctgtctcatgggttcaagaaattctcctgcctcagcctccctagtagctgggactacagtttcacacctccatgcctggctaatttttatatttttagtagagtcggggttttaccatattgatcaggcttttctcgagctcttgacctcagttgatccacccacctcggcctcctatagtgctgggattacaggcatgagccactgcgcccggactttttttttctcttgagacaggatctcgttcttttgcccagactggagtgcagtgtcatgatcatggctcactgcagcctcaaccttcggtgcttaagcgatcctcccacctcaacctcctgagcagctggaggcactacaggcttgccccaccatgcctggctaatttttaaaaagtttttgtagtgacggggtctccctgtgttgcccaggctggtctcgaactcctggattcaagcaggcttcctgcctcagtctcccaaagtgctgagactacaagcatgagccactgcacccggcctgcacttttttttttcttagacgagatggggtctcagtctgtagcccaggctggagtgcagtggtgtgatcatagctcactgcagccgcaaactcctgggctcatgcaaccacacccagctaatttttgtatttttagtagggatagggtttcaccgtgttggccagtctgttgaactcctagcctcaagtgatcctcctgcctcggcctcccaaagtgctgggattataggcgggagccaccgcgccgcctcctaccacacttacaatcaatccctagggcctcactggtacctcctttactccctattctcaacttctccaaacacagcctcctccgtgcttatgttcctcacccaagccaagcgtttgctgtgctacctgcccagaacaccatttcaccagatagtttctttgtttcatctgagtcttctctaaccctcattctaaaaccgtactccccacttaccacaggaagggtccattcccttatcccacttttgttttctttatatcactgttacctgcaattatgttatttagttatttgtttactgatgctgcgtcttcttttccttcctggaatataagttccaggaaggcagggactttgtgtagtttgctcatcattgtgttgtcaggacttagaacagtgggacgtagtaggtgctttatccacgtgtcaaatgaccgaatgaatgagcctagaatatagataaaatctgacacttgtcctaagagaagtataatgtgccctgcctttctgttccaatgttagtgtggaaatttctttaggttaagcgtggagtattttaatgtaagcagttcattaaccaatacacactcacctggtatccactatatttctgacactctcgtaataataatgatagctaatatttactgagcagttactacccttattgctttacatctattaactcatttaatcctcccaacctcttgaagcaggtacaattctcatcattttacagatgaggaaactgaggtacagagaagttaagttacttgtctaaggtcatacagaaggtaagcagtaggtccggggtttgaatacagaccatctgatttcagagcctgtgttcttcatcacaagctcctagctagagcaaggagtgcgcacaattcctgacctttgtaagcctgtcacgtttatggcttagcatagtggttctcaactggaggtgatttttgcctcccaggggacatttgacaatgtcaagagacatttttagttgtcatgactggcagggtttggaggtgctactggcgcctagtggggagaggtcgaggatgctggtaaacatcctacagtgcacagcacagcaccctcaccccaacaaacagtgatccggcccaagcattaatagtgccaaggttgagaaaccctgccgtggcacagtggttctgaaagcccgctgcccactggaatcactgggggagcttgataaatcaataccgatgtccaggtcttgttcctgaccttaataaacctcaaatggaccttcaacatggcctgcagtcctaccatgcttgcctagtgggtttgtttttccattctccaaaacagttgtttgacaccttttatttcctctgcccctcctagatcagttgctgattctggctcattcaacaggagcctcctcataacccactacctggacccccaacaggcccatatttgtgcaaataaagtgttccccagtgccactgtgaagctgtgactgaaatgcccctaatggatcaaaaactggctgcttttctgggctctgggtccctcatcctctttgtcttctcagggactttttttttttttacttttttttttttttttttgagacagattcttgccccgtcgcccaggctggagtgcagtggtgcaatctcggctcactgcaacctctgcctcccgggttcaggtgattctcctgcctcagcctcctgagtagctgggaccacaggtgcccatcaccacgcctggctatttttctttgtattttcagtagagatggggttgcgccatgctggccaggttggtctcgaattcctggcctccggtgatccgcctgcctcagtctcccaaagtgctgggattacaggcgtgagccaccgcacccggccttaacgttttatttggaaataattttaaactttacaaatgagctgaacattttttttaaaaagtacaaagaacaccccatgcccttaatccagattcctctgttgttagcattttatcctgtttgctttatcatttacactcttgctcgtgtacctaggattttcctgaaccatttgaagataaatttcatgcagcaagaactttaactcctaaatccttcagtagggatttcctaagtataagaatattctctcaaataatcacagcgctgttatcaatctcagtaaatgttttgataagatactgttatctaatctgccgtttgtattccaattttgacaatagacctgataacatcctttacagcatttttttccttctagtacaggatccagtttagggttgttgcattgattgattgattgattgagataggctggagtgcggtggcacaatctcggctcactgcaacctctgcctcccaggttcaagtgattctcctgcctcagcttcccgagtagctgggactacaggcacgtaccaccactcccagctaatttttgtatttttagtagacatggggttttgccatgttggccaggctggtctcaaactcctgacctcaggtgatctgcccgcctcagcctctcaaagtgctgagattacaggcgtgagccaccgcaccggcaggtttagagttgttgcatctagttgtcatgtctcttagtctcttttagtctggaacacttctattgcctttctttgtcctttgtaacgttgattttttttttttttttggttttttttttgttgttgttgttttgtgtttgagacagagtctcaccctgtcgccaggctggagtgcagtggcgcgatctcggctcactgcaacctccatctcccgggttcaagcaattcttctgcctcaaccacccgagtagctgggattacaggcacaagccaccacacccagctaatttttgtatttttagtagagacggggttttaccatgttggccaggatggtctcgatctcttgacctcgtgatccacctgccttggcctcccaaagtgctgagtgctgggattacagacaggtgtgagccaccttacccggccttttttttttttttttaatagaacattaatcatgtctggtttgtctgatgtctcttgtgattggactcaggttatgcatttttagcctgaacactgcgtggatgacattatatccttctcagggtatcttattttggaggctcataatgtccatctcttcctcattggtgatgttaattttgatcacttggccagggcattgtctaatttctccactgtgtagttattggtttttctttccaaatccacagtctgtgggaagacacaaatatcctgctcaaaatttccctctagggccaggtgtggtggctcacgcctgtaatcccagtactttgggaggcttacttggaggatcagttgagcccaggagttccagaccagcctgggcaacatagtaagaccccgtctctacaaagaaaattaaaaaattagccaggcatggtggtatgtgccagtggccccagctacttgggaggctgaggtattaggatcacttgaacccaggagatcgaggttgcaatgaaccattatcggaccactgcactccagcctgggtgacagagcaagaccctgtctgaaaataataataataataataataattccctttagatttagcatccagtgatgatttttgtatgatctattctttaatatggttgaaaataataattttcgactctagtattccctccacatttggtccagagcccttccttctcccctatttattgattgattcatctatttatttttggtatcaaataattcatattttcaaaataggtctgcaattcattactatacttaattattttagtgcacaaattgtaaaggacttaattatgcattgtttccttctctcttttctgcctaatgaactcctctctccctgttctagatcattcccatcagcttacaatcctgctctaatgtctaatatcttcatcaattccatattctcctccactcattccccacccccatttctagtcactccttctcagaagatcttcttaaaaggatgctcatattttatcacaccacattgtcagtcctcagtatatccacattggcaaatacagccatcacttctttacttaccatgttttacttggcggcagcatttgacagtcattccctccttctttgaccactttcttgttgtggcctccagtatcctacgctctcttggttttcctatctttctggtagctcattctaagtctcctcatcctctcttctacctatgaaggttgatgtccctccaaggcactgggaactgttcttctctttctacctactctcctgggatgagcccattcattcctatggctttccattccatctagatgccagtatctccagttgtgacctttcctacacttaagacttaataatttgcatgaatctctaagaggcatctcaaactcaatattttccaaagcaaaatcctgattccctgtcaccctcatgcaaaacctgattctctccctgtgaaatccatctcagtccatgacatcaccattcactccatcgttcaggctccacacctactagtttcatgccccacatccaacccatcaacaaatcttgtcaatttggcttctaaaccgtatcccaagtcttcccacttctctctactcctactattccactatacttccatccttctccgtctctttcttggatgattgtagtggcctcctagaatccaatatccacatggcagctagagtatcttcttaaaagcattagttggattgtgtcattccctactggactatggaagtctgccatgttctagtccctgcccctcttctatctctcttgctgactgtgcttctttattgattcttccagcacattaacctcattttagtcttttatactaactgttctgcctggaatgttctttctgtcctctactttatcttctgtttttttgttttttttttttgtttgttttttgtttttttttgagatagagtctctccctgtcacctaggttggagtgcagtggcgcaatcttggctcactgcgacccctgtctcccgggttcaagtgattcttgtgcctcagcctcctgagtagctgggattataggtgcatgcaaccacacccggctaatttttgtatttttagtagagaagatggggttttgccatgttggccaggctggtctcaaactcctggcctcaagggatccacccgcctcagcctcccaaagtgctgggattacaggcatgagccaccgcgcctggtccctcctttatcttcttattgctggttcctcatcattcagatctcagtttaaatatctcctctttgatgacctgatccaaaatagccaccaggttaccttctatatcatctcaccttactctaattctcaatgctgtatttattatctgttaatttccttgttgatttgtacatttattgttctcttctcctccttccaccctcctcacactagaatgtgagcagggtccacatctttacccccagtgcctagaatagtatttggcatgtagtattcaattttggtgtttaataaatatttgatgaataaatgatacatttaatccttcatgcatgattctcagcacatggaagatactcactaaatgtcctcttgttgtctttccccaagagtacattcttgtgtctggggctagtctagaagtttccagtgaagacaatcatctgataaagagattcatatttctgtgttaggatcctgattattagggtttctagacaaaggggaattacattttaccaagaaaaaaacagtgatagaattccagggatcattagtgtcacatttttcagtgtgggactttcctggccctcctaactacaagactggttctcagattccacaaaatcgacatgttttatcttgggattctgtcgtgtaaatttttgaaacacttcatttgggaggatcacgtggatttttaggtgggaagaaggggatagcaaaggaagtggcattcttctctgcctttgttaatagtatcatttcctgtgcccatttcaacgttagctctggtataacacaagtgataagccgtgtgtgttattgaaatctgagaaaagggcaccaaaaaatgtttagtactttgtactggtctaaaattcatgacttgaatatgtggggagagagtgaggaagattgggaagatgtatactgaagtggtttccctttgaggtattatttgaagattggtgtgatttttgggaaagctcttgtagtggattttaaagcttccaggaaaaaatctgtaccaatgaacacgactaatgattttgtcagcagatgattcgctttttgacagaaatataccacatgtttttggggtatttggagaaaccatcacccttgacccagtaggatttttttttaaactgggccaaatgcttattgtattcacagttcatacatgagtcaagagctgggcgccattactcagcttgtgatattgatcacctgttcatcacgattcatcatttcaagcagccatccttatgaaagcaggcaagtgtgtcaagtagtatttcatggacatatttagagcgttcttcttcttccttcttctttcttcttcttcttcttttttgagatggggtctccctatattgcccaggctggtcttgaactcctgggctcaagtgatccttctgcctcagcctgagtgttactctctttgacttatccataaaagtggatccaatgtgtctacatatattttttaaattaaacttttattgaagtacaaattatacacattacaaatgtacagctcaatgaattttcacaaactgtgcatatccctgtcaccagcccccagatcaagaatcccacacaagcagcctttagaagccctcctcttgcctcctttcactcactgccccccaagggtgactactgttctccctcaaatgccacatattgtgcctgttcttaaatttcctatatgtggtaccagacaggctacctgacttctgctcagtattgtttgtgaatttcctccatatcgttgcatgtggttatagttgggtgattgtcactgccgaataatattccgttgcatgattaccatggtttatcctttctactgctgatggcctttgtttggtttccagcagttttggcttttatgagtggtgctgtgggtgattctcttgcctatcttgtagtgaacatatatgtgcattactaccaggtaaatacctaaaagaatgctttaaatagattattaatagtttttatggttactgtcaattattttctcctctgaatgcaattaggattagtagccacctttggacataactcacacatctgtatccatagacaatgatgagactttctttctgtaactttttttttttcttgaactcctcaagcaacctgcccgcctcagcttcctaaactgctgggattacaggcatgagccaccgcacctggctttctgtaactttttttattaagttctagcattagttgtttttacactttaattttcttttttctttttttttttttttttgagacggagtctcactgtcacccaggctggagtgctggagtgcagtggcgcgatctcggctcactgcaaccttgtgtcacctcccggagcgattctcctacctcagcctcctgagtagctgggactacaggtgcgtgccaccacacctggctaattttttgtatttttagtagagactgggtttcaccgtgttagccaggatggtctcgatctcctgactttgtgatccgcccgcctcagcctcccaaagtgctgggattacagacgtgagccaccgcgcccagcctatactttaatttttttctaataattggtttctatgctgattttttcctttaccaactacctatatcatatcatcattttaaaatatcttaagaattttagcttgctttttcttttcctgcctgcccccaccatccccacccccagctgtatttcttttgaaatgaaaaaaaaaaaaaaaacaaaaaacaaaactcctggaactgctgaatgtgttttgcagatatagaggtaaaggtttaccacccgaatagctttagaatggtacaggcttattcagcactgattcctagtcttgccaaggaaaagtaaaaaggacaaagaaaggaagaaagaaggagggttaaaaaactaaattatgctttattttgtggtgtattggttgacagtagtatttttctctgtctcctctcagctaatctggtcatttgaccaactggatagagcaaatattgtctgaaatgaagcaaatacattccatttgattttggtgggagacaaatttttaggcagggaaaacgattagcagatagtgtcatgcacagcagtgcctttcaaatgccaacatgcaaaacgattgcctggggatcttgttaaaatgcatatgcggattcagcaggtttgggactggccagagatttctgcattgcagctcctaggtgaggtgatgctgctgttggggcgggggagctgcactttgagtagcgaagctttagaacatagctgcctccatgttcctggggattatatggagcatttgcccgttgcccactgatggatgataaacagctctcccaagtacccctctgggcttgtcctctcagcactgccggcagaaccaggttgtgtgtagcctgcattaaagcagcagacaaagcccagggctcttcttttttttttgagacagagtctcactctgtcacccaggctggagtgcagtggcatgatctcggctcactgcaacctccacctcccgggttcaagtgattctcatgcctcagcctcccgagtagctgggattgtaggtgcccgccaccaccgcccagctaatttttgtatttttagtagagacggggtttcaccatgttgcccaggctggtctcgaactcctggcctcaagcgatctgcccacctcggcctcccaaagtgctgggattacaggcgtgagccactgcacccagccgcagtgctctttttttaacctggaatagcaacttctttcaaatctccctcacctggactctcctcaaatatctcataacacctgaagaaaaaccactaacctcaaacacacgccaaaccgaaacacacacacacacacacacaaacacacactatcccagatactgacatggagaaaggagtggggtggggcaggcattaagccactcttttttctcctggcttcactatcgcacacttcctcattcattccagagcaactaggtgtctgtttcaacatccctggccccaccattatagtacacaccagtcaccttccagccacgagctgcacatttctctgtgggggccctctttacacatccatgctgcaggttggaagtgccagggaattaacagctcccaccccaccccaggagcagccttcaaccaatgcctgatgcaagtcagtggatccataccctcaagtgggataattcagaccggtgttctacactggctcccagaattccccagaaggactaaactcccattgcccccagtggtgactggcttgataacgccatctattggctgccttcctgccccaactcacgtgtccattctatctgtgtttcctggggtcacagcccagataaactacttatctcgaatatgtgccaaagagttaccttcttcttcttcttctttttttttttttttttttttttgagacagagtctcgctctgtcgcttagactggagtgcagtggtgcgatcttggctcactgcaacctccgcctcccaggttcaagtgattctcccaacccagtagctggaattacaggtgcacgccaccatgctaatttttgtatttttagtagagacggggtatttcagctaatttttgtatttaaaaaaattttttttattatactttaagttctggggtacatgtgcagaacgtgcaggtttgttacataggtatacacgtgccgtggtggtttgctgcacccatcaactcatcacctacattaggtatttcttctagtgcttttcctcccctagccgcccatccccctacaggcccccgtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgcaaaggcctatttaacatggcctaaatagcaactaattatagttggatgattgtcactgccaaataatattccactgcatgactaccatggtttatcctttctactgctgatggccttgtgtataatttgtactacaataaaagtttaatttaaaaaatatacatagacacattggatccactttcatggatgagtcaaagagaataacactcaggctgaggcagaaggattgcttgagcccaggagttcaagaccagcctaggcaatatgggaagactccatctcgaagaagcagcagcagcagaaaaagaaagaaggaagaagaaatacaaaacacataatttttgtatttttagtagagacggggtttcactatgttggccaggctggtctcgaactcctggcctcaagcaatctgcctacttcggcctcctaatgtgctgggattacaggcatgagccaccacgcccagccttggagttactttttttttttttttttttttttttgagacagagtctcgctctatcacctagacgagagtgcagtggtgtgatcttggctcactgcaacctccacctctcgggttcaagcgattctgctccctcagcctcccaagtagctgggactacaggcacccgccaccacccccagctaatttttgtatttttagtagagacggggtttcaccatgttgaccaggctggtcttcaactcctggcctcactcaagtgatccacccaccttggtctcccaaaatgttgggattacaggcatgagccaccacacccagcagagttaccttctgaaggaacccaactaaggcaaaactggtcaacagtcaggaattccttttgttaattttaataaaatcctattataaaaaaagggggagccccatggggtttcttctgaggggcatctcaccagtatctagatattttgtctgcgtgacaccaaacagtcagatggctggaaataagcctgataatggagagaatgcttctctgttcccgggctgttttgggatctggtcaacagagttgattttctggacaccccagtcaagctagttcaggtctttttgacctgtacccagagggtgtatctctgagttctgcctcagaagcttgatcacatcccgggggctcctacaaaccacatcctggctgcagccaactcccttccacaggcctccctcactgagtttctctgtggtgggttctctgcatagcctcttgggatgaggagtccttctcagacctttacagaacagagcccctgacactcagtttcaagggcctacctacatccgtttccgaagctttgcatcgatggtcactgctcctcttagccatgtcctcagctttctcctcctcctgccttcttccccagactgaagtggatctgaaccttggcacaatctatgcctcttagtgcattttaggggattttagggctgcctgggcccctctatatgttcagacgtgtgataggacccagccttttcccctcaagaccttgtatttgaaattccccattctatggtttgtctcatctttggaacccacagcaggcagagatgtttgggagggtggcctcactgggcacactgtcctggatgtctcacagttttgcatacctctgccaggctgtgctgcccccaggccagactcctgtttctctgtttgggcatcttgggggtcctaattagacacttagtcctttggatttggtattttgagagtacacgtggtatcaacagggctagctttaatgttaaaacatctattaaaacaataagggtggatggctaggtgactgctactgttactaaaagaggtcccgatccagaccccaaaagagggttcttggacctcatacaagaaagaattaggagcaagtccatagagtaaagtgaaatcaagtttattaagaaagtaaaggaataaagaatgtttgctccgtaggcagagcagtggcatgggctgctcgactgagaatacttagagttatttcttgattatatgctaaacaagaggtggattattcgtgagttttctgggatggggcagggaattcccggaactgagagttcctcccctttttacactgtaaagggtaacttcctgatgttgccatggcatttgtaaaccgtcatggcgctggtgggagtgtttttagcatgctaatgcattataattagcgtataatgagcagtgaggacaaccagaggtcatttttgtcgtcatcttggtttttggtgcattttggctggcctctttaccgcatcctgttttatcagcagggtctttgtgacctgtatcttgtgccgacctcctgtctcatcctgtgactaagaatgcctaacctcctgtgaatgcagcccaacaggtctcagccttattttacccagtccctattcaagatggagtcactctggctcaaatgcctctgacactaccctgtaactttcttagtcaacttgggctgccagaacaaaataccatagattgagtggtctaaacaacagaaatttatttctcttaattctggaggccgagaagtccaagatcaagatgctggcatggtcaggttctggtgagttccctcttctgggtttatagacagctgccttctcactgtgtcctcagttggcagagagaggtgggggaagcggggagggagagggagagggagagacaggttaccctgggggttagggcttcaaaatatgaatttggcaggagggacacacaagtccacagcaataactgtgcatgactccacccccatctccccacccccaccagtatctcatctgttgatctggctgaaatctgaaattccacaattagagattcatttccttggtttaaagtgttataatttaaatgagcacagaacctggtcgatgggcctccatgcgaggccttctcctgagagccagtgaaaaagtatgaggtcactgggcacctacaagttgggaatggcccccacctagaagacacaaagagtactaaagaggaaattgattttcttcaagtgaggtgggcttgttaactttgccaaggcctgtcctagtcctcagagttatgttcatatcagttcctgcaaaataccccttaaaataagagaaatgagtccttcatcttgcttttttgcatctatgagtgatgtgaaagacattgccttttaaagagggagtccaggccgggcgtggtggctcacacctgtaatcccagcactttggtcttgaactcctgggctcaagtgatctgcctgccttggcctcccaaagtgctgggattacaggtgtgagccaccacacccggcaatattttcaccgcaatacttcatcttcctcccctactaacatccaaatggtacctgaagtaaagcgagccacttcttatggcttgttattgctgggaacagctgcttgtggataattagctcaggcaatcagaacactgggtcaggaaatcaggcacgtgggtctgactcctgtatggcctttgctcttggggacctgttgagggtgggtcactgctggttcagtatgtgctgcatgtggaattccatcccctttgaacctgtaccattaatggggtaacagctggaggtgcttaactttggccctgcatcagttttcaaaagtgcataaaggtaagcactatcctgaaactgttgtttatctttctcatacatttctttttttttttgagattgcgtctcactctatggcccaggctggagtgcagtagctccatcccagctcactgcagccttggcctcctaggctcaaatgatcctcccatctcagcctcccaagtagctgagactacaggtgcacaccactagggtcggctaatttttgtattttttgtagagaaagagtttcaccatgttgcccagactggtctcgaactcctagactcaagtgattcgcccacctcggcctcccaaagtgctgggattacaggcgtgagccaccgtgcctggctatccttctaatacatttctttatattttcctacataggaatatgtccttaagcaagagagaatgctactcgcatgccttttaagctttataagattggtgtgttttttactttcacattttgcaactttcatctcatttaatactatttttgtgagattgattctcttggctacatgtagctctagctcatttttcttcctttgctttatccacaaaccactcccagagaacaactgaactcacagttgccagggtgggggaagagcaggaattacacacacacacacacacacacacacacacacacacacacacaatctcatgattagttgatttgaaacacacctcaagctattctcataactaaatcttaatccaaccaataattcctttagattttaaccacttaactttggaaattgttttataaagctctagttcttccatatgttcacaactcacaaaattggttttgcaaataatccttttaccctttgcccgcgaggaatcgcaaagctgagtttgctttcatttgccatcgcttttcttcccgttttcagatgtcgttatctttctgtttccttttttacttggcatagatttgccttcctttcccaatagtatgtccaactctttcaaaacctctccattcattcagccatgcattcttttcacatatgtttataacatccctagtatgtgccaggcacttttgcaggcactggggactcaacagtaaaccaagcagacaaaacttctgccttcggcaaagaagcttatcttccagtgagtgaagcagacggtatttgagtaaaatacacggtcagttagatggtgttaggtggtgtctgtggaggaaaatgaatcttgggaaagaggcacaggaagccgtgaggggttgcaattttatatagcatttttctaggccaggggttggcaaaccatggcccaaggccctccatctgtttctgtaaatgaaggtttattggaacagagtcacgctcattcacttacatgttttccatggctgcttttgcattgcaacagcagagttcagtcattgcaatggagaccattttggctgcaaagcctaaaatagttcatatttggccttttacagaaaatatttactatttgaccctttgcagaggaaatgcagatttttacctatgataacttttgaggattctacccatgttgtgcttttcagcttctaaagcgttgtcaggaacacgatgtcatctgagtgttgaagtagtgtttgttatgaggtaggtctcagtagctttgttttacaggtgactcaactgaggcttgaaggggttattatggttgtccagggttgctgaccttgtaaagtggtcgtgttttttggtgtttttttgagacagggtcttgctctgttgtccaggctggatgcagtggcatgatcatggctcactgcagcctcaacctcctgggctcaagtgatcctcccacctcagcctcccaagtagctggaaccacaggcatacacaaccatgcccagctaatttttgaattttttgtagagatggggtttctctatgttgcccaggctggtctcaaatccctgggttcaagggatcctttcagctcaggctcccaaaatgttgggattacaggcatcagccactgtgcctggcctaatgctggtgttcaactctaaaagctggtgcgttttctactttccagtgacaaatacaacccaggtttttagcgtgacgagcttctaagcacatgaaacacagataggcaatcacgtgtaggtgtcacgaatgtgggctcagaagctcagcagcccaagttcaaatgcttgttctgccacttacctttgtgacatcaggcaagttatttaacctctctgtgccctgcctcagtttccttgtctgtaaagcagtcataattgtatgccttctaggtcaggtggtgctgtatcttggttttgccaaggcagctctgatttatgcctgttttttccacattaatcaatagtgccccattttactctcacatacccccatttggacattaaattatgtgcatgccctaaccagggtcgttgcagagattaagtgagttaatacaaataaagcaagttaatacaaataaagcagttcaatccatgctgtaggaagcatttgctagactttggctgttgtttcttgtcaaggccatgccagcccatcacttaatttttttttttttaacttttttagatggagtctcgctctatcgcccaggctggagtgcagtggcgcgatctcagctcactgcaacctccacctcctgggttcaagcagttctcctgccttaccctccagagaagctgggattacaggcgcctgctaccacgcctggctaatttttgtattttagtagagatggggtttcaccatgttagccaggctggtctcgaactcctgacctcaagtgatctacctgccttggcctcccaaagtgctgggattataggcatgagctactgtacctggcctcacttaattttcttctgacccattgctttgtcccattaagtctgaactgatttctgtctggagcaattttgcttatctgggttaataggtgattgaggattcatcttctgtgtggcagtgccttctggctcactccctgacctcccttagcagctttgctcagatgtcatcttctcatgatggtgtcacaggacacctctctaaaattgctacctcccccacctccaacacacttcatatccacttctctgctttatgtgtttgctttatagttattactaacatacaggttttactgagctactactgatgtggttctgttttgctgttacttggataaaaaaaaaatcctacaaaatctgctatgcctgtgagaatatttatttttatgttttaaaaaaatgtatctttatcattacattttcagaaattacagaaaaacccagtaaaaaattcagcccacccatggtcccccctccagttggcattttgctgtgtatcaagaatacagcaattttaccccacctctagagggagtacattttctaatctaaccatataactttagctaaacagcttacaagcaaatgacagtttactatgttctctaagtattattttgattcctttaaaaggagatttttcctacacattttcatctgaagctggcctaggaggaaatataaacacactggtctagcctagtcccatctctagaagtaaaggaaaaaaaaaacatagaagagaaattgagtgaaaaggcatgttccctcacttgcagttagctttctggcacggtggcaaagcattggcctggcgcctgccaaaatgagcatcttaatagaaattatcatgtgtgacattcctttgaattgctaactttctttgtaatattgagcaagttgctttttgcatcattgatataattcatcttcttatgtgtttgctttatagctctctttaaaactgtcagtgtttcacagattgatccatttgcgtttttatttgtttgaatgccgcactggcacgtacaacccaaaagggcacagttgtgtgtgtcttgttcaccactgcactcctagcacctcccgtagtgcctagcacatggtatttacttaataaatatttgttgaatgggaaggtgcctgagcacagcagagtacgctcaccctcgatgcagtgagggtgtcctgccaccggggccggggtggggaggagatgacccagtataaggtcctcagctgcgagagaatgaacctccaaaatgtggtcttggtccctcaaatagcattcacactttctcccccaggccccggattcctgtaacaaaggataagtcattaattcagtcctccgagttggtttaaagaacagatgcctttgttttttttgagacggagtctcaccctgttgctcaggctaaagtgcagtggcgctatctcggttcacttcaacctccacctcccggattgaagcgattctcctgcctcagcctccccagtagctgggattacaggcacctgctaccacgcctggctaatttttgtattttagtagagatggggttttgccatgttggccaggctggtctcgaactcctgacctcaagtgatccacccgccttggcctcccaaagtgctgagattacaggcgtaagccacaacgcctggccaaagaagagataccttttgagagaggaagctcaataggaccttcacacgaagaggtcaggtgtgatattagctccattcctgggacagctgtgatcaagtgggagcggaaagaagagcataaggaggggaggcagagaggggctgggtggagtggcatggccaaggaggaaaacatgcaggaagggcagcaggcccatgccagacctcttctcttctagaaaagcacatgaagtgtcagccacagagatgtatgtggagcaatttgcagagtgcctggtgcccggaagcagttaacgatggcactaacactcacagctaatatttttgagcatgtgctctaagccaaagtctgctaagcactttccctgtactgactgactcattactcataagaattttaggacataaataagaagtttatccccatttgatgggtaaagaatcccaggtatggaggcagtaaatatcagcaactactttatcccatgacttgtgataggctacaattaaacactggctgttatcatcatgactcactgaaaatacctcaccacctccctacacctcccttttttctgtaatagtgaaaaggctttgacaatgttgtcaataatgtggcattagtactataggataaccaaaagcagcttgtaatatttatggcaagggagttttaaaagatcttttgagatattgtacacttgttcttacttgcatgagcacattacatttttatccaggcagaatcatttttctatcaaatggtagttttcaacctattgctaactgcaatactgattttttttttttttttttttagatagagtctcgctctgtcacccaggctggagtacagtggcgcaatcttggctcactgcagcctccacctcctgggttcaagcaattctccctgcctcagcctctcaagtacctgggattacaggcacatgctaccatgcctggctaatttttttatttttggtagagacagggtttcaccatgttggccaggctggtctcaaactcctgacctcaggtgatccgcctgactcagcctcccaaagtgttgggattacaggcgtgagccaccgcacctggcctggtccatttccttttaaccctgcctttccaatgagaacctgggagatgattaaaatattccattttatatgtacactgcactttaaaaatttttttaatttaattttttgagacaagggctccctctgttgcccaggctggagtgcagtggcacagtctttgttcactgcagcctcaacctcctggactcaagcaatcctcccatctcagcctcccaagtagctggggctactggcacatgcccccacacccagctaatttctgtattttttattgagatgggggagggtctcactatgttgcccaggctggactccaactcctggactcgagtgatcctcccaccttggcctcccaaagtgctgggataacaggtgtgagccattgcgcctggctccccggcactgtttttactataaaatttttcagctgtccccgagactagattatgtgattactttattttggatgagagaattgatgtttactttttcctcagcattctatttatcattctaattaacaagttaccagtttcactaataaaatgcttttggcatttgatatgctgattagcgaagtgtggattgtaggtcaaggtcacaatggcagaaggacgtgtaggagctgccttgagagagtggcctttgtgctataaagtttgcagagcactcatcgagttcaagcttaaactcaccggcacacacaaacatcacactgccttccctgcggtatattaaagtgagttccagacctcataacaggcaggcccggggcacctcatggttcatggaggctttggggtacagtggcaagtgattagctttgggagtaacatgactcatgtagtctcccgttttctcaaattatctggtgagttagtctcttactgcaagggaaaaaataatactcccacaccacttggaacaccccagttttgggaaaatcactcaaaaaatgctgcttagccacccatgcagcatccgtgctgctggagggtcatttgggaaaaggcagcgtccagacgcctgcgggaggcaggatttttatgggctgtttttgtgtccagtttcgtagttttcagaggagtccattcaggctgtcaatgggaaccgttgaacctgtcaagttgctgtttgccgggtctcttggaaaaacacactgcaacatcccagccctgggcgggtcagagaggatagtactaaaaaaagaaggagaaagtggacggccccgctctggtgggaggccagggcttggggctgcagccaagttccctggtgatagaggagtttccaccatccaaggcttcccgttctggctccctccaccctaccgtacaccatccagccttccaaaataactccgcttccggtggaaccgggcagagtcactggaatgcgtggtaagcagaaggagcaggtagagttgatgctgggagagaaagtgttttgatgagcaaggaaagaaagtcgaacaggaaggccagccagccactgcaagactttcctggcagtaggaacactgatgggaatggcactgacttccagtttctgaggcgcagcccagcaaacccatcaaggtaggcaaagcccttccttgggagtcatccccatacctcctcctcctctctctcccagttaacagcaggccttcccatcccaatgtgcgtgcgttgtccatgcctgacctcactgggctctgcctggtcactgaggcctgctgtatccctgttcaccacccaaactgacctgatcattaaaaaaaaaatagatttaggaggtacaattgcagctttgttacatgaaggtattgtgtattggtgaagtctgggctttgagtgtaaccatcaccaggatagtgtacattatagccgttaggtaatttctcacccctcacctacctctcaccctccctgctttctatccatactgtatgtccatctatccatactctgtgtccatctatccatactctatgtctatccatactctatatccatctatccacactctatgttgatctatccatactctatgtccatgtcacattatttacctcccaattataagtaagaacatgcagtatttggctttctgtttctgagttaagataatggcctccagtttcatccatgttgctgcaaaggacatgatttcattctttttcatggctgggtagtattccatggggtgtgtgtgtgtgtgtgtgtgtgtgtgtgtgtgtgtatacctacataccacatttatgtccaccattgatagacacttaggttgattccatatctttgctattgtgaatagtctgacttgataaattaagtcacacgtgcccattagtgaccacagtcattgaaatttgcatgttttattgggtgcaagcccttaccaaaaaaacaaccaaacaaaaacagaaacaagccttgagaggtggtctcttagatactagtcaaaaattaaaaacaacttttggggtggaggaggagtcctactctagtgaagtcttaatagactctaggtcaccgtcatcttcagattctctggtatagaacatgtttacatgctccctgcccgccatctccccaaacacacaaaagatagaatcagtcactcccatctttgtgtcctcaaagcagtgttcttatgaccatgagcacgttttctcccactgttcatccacgcataggagtgaacatgtgagtttcttgccttctcagaacgttcccctttatcctctccttgtgcacacagactggcctccatttagaagaggggctcagtcaagggccacaacttcctgcagactgtgggatctaccattcaagactgctgagaggaggagtaacctgagatctgagaattgtgccaaggtggaagttatgaccttgataagaataacacaaaagcccgattgaaatcagttcaggagacgctgggaagaggaagtggaggtgctgagtgtggccaaaccctgagcaggttagttgaggactagctaagaggaaaagcttggccttctctaaggattgtcatgttttctcttgttcatggatgagatttcagaataaaacacgatccccttttctatttgggcaccaaagagccatgtttgtagtttgttaatataaaggtgaaggccttgtgacctacttacctacttcctaacttcccagtttccctccttggtcctgatctccttctgtaatttatattctccttgatcctgcctttctttgcagggagtgaggaggggaatacaaagtgccgttttgtcatctgtggtcttggttgttaattgcctgttagccttcacagaacaagtgcaactgaaggctctaagacacaagtcaacgtgaaggtcctcctccatctcgccagacaactcctggactaggtcctggttcaggatgggtttgtgcagttgctgcagacagaggcaaggactgaattttaagatgctgggtgaggagggtgaggctggagggtaagagcaggtaaaaagggactgtgcataccccacttggagctgcaggactgctttccctctcttgctgggccaggctatggccttcccctgcagcttgggaagttactgtcctcgcacctgcccgtttgggtttcctctccccctcctgcctttgaccctgctcctcatcctctccagacacctgactccaagctcatctttctaaagctgctctgtctggttaatttcaccccctcccccaattttattctcgcccccatcaagttaggcattgactgtctactctgctaatttgttgtcattgatacctgacttattttcaagttgttgcaggggaactgatgtgagggaaaaagctggaaggtgttgttaactctgtagaaattgtatgtgactatgaaggccaaaagcatttcgagaaagcatcccatacacttgtaacctagcagcagtgggatgctgggatgctgcaagggctgggatcaaaggctgtggattgggctggcagagggccggtggctgtggtgggaaggcacaccagacccaaggggtggacaagttgtcagatgacctggattctagttcacatgcagctgcttcactgcgtttgatcctcacttgccttagctgaactctaggcagtgcctgccactctttcactctttatatccaacccagacccaagtcgcgtcaattcttcctcccaaatactgctcagtatgtccatcattcatcaccaccaccaccatcttcatccagccttgtttctcacctcgaataccgtaattacttcctcgttggtagagagcagggcaaactagcgcccacaggccaaatcccacaagctgcctgtgtttataaataaagctttattagcacacagccacactcattcatttacagattgcctgtggctgtttttgtgctgtaatggcagagttgagtaattgcaacagaaatcctgcagcctgcaaagctggaaatatttactatcttacccttgcagaaaagatctgcaggcccctggtgtagaggaaaatcatttgtataattattctgactcttcttttctgaactctaatacccattacattttaatagattttcgtgtgtgtgtgtgtgtgtgtgtgtgtgtgtgtgtgtgtgtgtgtgacataaaatctgtagtctccatttcttgattctaactcttactttgtatttttgttttactgaattgctcagaccttcagaacaatgtttgagaatggagagctaaaattccaaactggacccccacttccactaagaccccctcctattcattttccatgcaaaaattgctagaacaatcttgtcaaaatgtgaatctgaacacgctgcccactgtttaaaatccttcagtgactttccatggctctcaaagcaagggtgcaaatccttaccttggccaccaagcccccttgggagctgagccttttctgtctctccagcctcatctttcactgtcctctccttgccacggcatgtcctgtccactcctacctttcttcagttccttacatgagtgacattccctcttgccacagtgcctttgcacatattacttcctctacttgatacggtctttccttgcctctttggtgggcaagttcctctcacccttccagtttcagcatcacttccacagggaagccttccccagtcccttaggtcagatccccctgtcttcacccagagctcctgttgcattgctttgtggcacttgctgtaatcgcaatatcgcacttcttggtgtgaatttttgtatcatatctctgtttccccattagaatatgaacacttacccaacctcaacatctaatttgacctttctaaacattaacatcataaccacaaacaaataggttctgggacactaaggaaaaatcaacttttaaaaagtgcaaaaaaaaaatacatcattcaggagaaaaaaataagttagagtgagaataaagaataaattagaaatgtggaagaggaaagacaagcattttaagaaatgaccttctggcttctgagttgtactgagtggcttgatgtcattagcaagatgaacgtattgattttctcttatttgtatagtaaacaaatggaaatttaagcattttaccactcacagtacattgtttcctgtagttataaatatattttcttctttcttagcctgcgcagccacgtgagggagggggtcttaaaccatgcctcttaacccttgggcatctggctcgaaggcccattttcttctcctctctgctggctaggagcaatgggtagaagggagggctagaacacacttaacaggtcacagtgacaaatatttctttcagggagattatcatgagcaaatgcccagaaacgggctgcaaactctgcccagtgtccccagaaacatcttggttcatctctttatgagtagggcccatggaccatgcaaggtctgcagaatctgcttatgtgggttccagagggagtgtatagagggagtgtataaaagaaaatgaggcaggctttgaattagaatcagcccaggccagcattttatacataatgggcccttcccttaaattggtacttgtagtacttacagaaggaaaagaagaaaggaagatgagtggagagaaataatgaaaggaagaaagggtaaagaggaagggaagaaagaaggtgtataagttagttttttccacataacaaaacagcccaaaatttagcagcttaaagcaacaaccatttaattagttcacattttttgagtccacagtcttggcagggctcagcaagatggttcttctgctggtctcggttgggctcactcatgcatctgttgtcacctgccagtctaccagatgaccctttgcctgggggttggccagctcttggttggagcaatgcctgaccaggcgtgggtctttcatcatctggccaactagctcaggctggtttccactcttacatggtggcttgagccttaaagagcagcaagagagagcaaattccatgctcaagcacttttcacacttttggttgtatcacatttgctgcattcaaggggtggagcattcaaggggtagagcaacaaaatcacattgcatggattttgcaatgtaattttggataggcaaaatagataggcaaactagaataggaaaagtttggtttttattttatttttatttaacttttattttaagttcaagtatacatgtgcaggtttgttatatgggtaaacttgtgtcatgggggtttgttgtgcatattatttcatcacccaggtattaagcctagaacccactagttatttttcctgatcctctccctcctcccaccctccaccctaggaagagtttatgagtagctttgcaatcagccacaaaagggaggggctagaaacttctcttgctggcaaagttggcagagatacagcaattttgaggtggagtttgaggtcttcatattgaatttttaaaatgttattaataaatcactaaattcctatcttccacagtttttctgtcaaatagggctagataataatgtaacttcttaatcatttccagtgagaataataacaactttatgggcaagggtttcctcatcttttatttcctggagttaaggtttagtacatctcacgtggcagatatatatggaaacaggaaaattttaatgcaccagccttaatttgtagcccaagtgtccaatatacaacaaaggcttactaaacaaaggaaacatttatgtgtgtggttttcttactacttggtgagacccatcctacatgaacaattgctctttccttatctgtgtagcttttggtcgtattttctctcatcattgaaaatacaatatcaggccaggtgtggtggctcacacctgtaatctcaggactttgggaggcagaggcagaaggattgcttgaccccaggagttggagaccagcctgggcaacatagtgaaacccatcaagtagctgggtgtggtggcatgtgtctgtagtcccagctactcaggaggctgaggtgacagcatcacttgagcctgggatattgagtctgcagtaattgcgccactgcacttcagcctgagcaacagaggagacccagtctcaaagaaaaaacaaataaacaaacaaaaaacaaaaaagaaaagaaaatatcaaaagaaaatatcaaaacatagtttaaacagagggaaatggccagtgtttgttgctacccagtggaaagagaagttgagttaattagaaaatgttagtcatcttaattgagattgatttaagttgtgatgatccaaattcaattatcctgtgaagtgttttcatattaatggaagaaagctcactctggtgaactttgtgtgaatatagcttaatgtcagacttgcatttaaaaaatcaagtatataagtgttctttttgtgaaatagtaaattaatgtttttgtaaaagaattggtaaattcttgcctatgcatttgtgaaagtgagaattgtttatagtctaaggaaggttatgtcctgttttggaatgccttagttctgtcatcttgggtagagagttggtggttgcctcacccagaccactgggactggaggtctgggagtcatttgaaggtgaggctctcaccatgtggtctttgatactctcttctccagctctgggcagaggtgaccagcaacattctagcccccggaatacacgtggcaagccttaagctagggaagggaagggaaggaaaacggggacactgtagggtgaaagagagtagaagagaaaagagggagagaagactggagggaagggaagagagaaaagaaagcttctcgtgctgcaggaaaataaagcatggtagcaacggctgcaagaggcccactgacgacttctcctggctgcttccttccacctcagcatgcagcccctccagactgatgaccaggggtcatcttttgagatgttttacaaagcaattccgaaagctctgttagtcacttgtacaatttaacaaggatggacaccaggacactgtctttccactttaaactctttggctgtgccttggtttcagccatttcctctctttggaatgctctcgcccatgtcttcatataaagggagttgcaccctttaagctgcagcctgatgattacttcctagatgagattttcctggatccatttccccacactgggttaggtgtccttcctcggtgctcccattactgcccacagctgatgccaaagcctggcattctggattcaggctcgctggtgcccttggccgtgagcctttgtgcagggcacaacctgcacaaccgtacagagcagccttgttttttggcacatagtaggcacccagttaaatgtttgttgaatgaatgatctttagttttccagaaccatctcacaatttaactcctcttgagtggtggcattcagaactgaacaaaccagtctgtgaaggtcagggtcctattaggcagggtctgatcagtactggggccaccacaaggttctagaaccactcttgtttgttcctcgatggcaatacctaccactctaagaccaagaatgtgcatatgcccaaccttctcctgcatataactttgccttccccatcatctccatttgggcaatttgtttttcctcccagtgtgaagaaactcctctttccttctctctggccccatcccgatgtatcaagacctctttgtcctctggtcatttcttccatggtgtcggtgtcagtgtcattgccaggaacttcgagccagtctgtgcctgtcggtctaggtcactaatgaatcattaggttcctaatgaagtgctgagccctccaggatgctgtatgtcatggttctgttttggttggttttggtttttttggttggtccttccttggagggcagtgggacaactgcctggggctgctgttacctgtgctccttcccaagtgggttgcagattatccctaggatgtgtgggtgctgtggccaggtgcccaggatgggagttctgactcttggacgcagcctccctgtgagcggccctgaactggagcagggctcttaagtacacccggaggtcatttccttcccacccaaaccacttgtaaagtctgcctgccttttttaaaatttatttttttgggtcacgctggtattaccctgggttttagccagcttgataaatagaggaagttgggtggcttcccagcctccctgatgtcatggtttggggcaatctgcaactgtgggaggtttcatgaatcctagcaagtggtgagtttgctgttcttctctgcgaaatttctctgttccgtgccatgtcttacataagttgatatggttccttttgtgacttgccctttcccttcaatgatgtaagaaccccaaacattggtagtcactatgttttgtcactgaagcgctggtgctcatcagatcctcattcctgttccgcttctctaggagataaaggctggtgggtgtgtggtggccacaggggcaaggagggatctgtggactgaaggatgggcctttctttaatgaagttgaggccttggtattcatcaggcatttttgcatcattgcttttgccattattttccacaacttgctgaagtgagttcctgctccctggctgggaagctggtttcttggccctgaaaccagaagtctttgtgttcccagttgggcctttctaactgaggtagagcaggcgaaggggagatgacgttgagctgagcaagtgatggctttccgtcccattccccacccactgagcttgatggaggagctctgttcagccctccttctgcttttcttcactagaagaaatctacttaattgtgtaagtactatgtaaagacatgcctgtggtctatggagtagcaatttggcttcatcctttccctcatcacactcctgggttactggtgggtttccttccaggctattttgtatgcatccacccttgtcactgtattaataaggataggccatgtgcagtggctcacatatgtaatctcagcactttgggtggtcaaggcgggaggattgcttgagtccaggagtttgagaccagcctgggcaacatggtgagaccccatctctacaaaaaactaacaaattagccgagcatggttgcacgtgactgtagtcttagctacccaggagactgaggtgggaggatcacttgaacccaggagtgggaggctgcagtgagctgtgatcgagccactgcacttcagcctgggcgacaaggcaagaccccatttctaattaaaaaataagcatacacatataactttgattgcatcttaacaagtcctcgtatatatattattcagaaacttggttttttctcttgccttatatgcattgacagtctctgtatgttaatacacctaaatgaacttcacttttaagtgttgcataatattccaaaacacagatgtgccattgtttaactcttcatctactaatggaaacttaggctccccccaccacacacacagctgcaatgacagtatttgtgtgtatatttttgtatctatgggtcagtatttctgtggggacaatctctggaattcaaatttctgtatcaaaaagcatgcacatttaaaattttaaaacatagctaaattactctctcaaagtttatgtttccaccaatggtgtatgcaggtgtttatttccccacatgctctccagctttggatattactaggcttttcaattttttcatccactgggaaaaacaaatgtcatgttgcttgccctacttttctacctgtaagtattccaagggagcgaacagagcctcctgttgttcattaataaactggattcccaagaaccattaagtgtgctttattatggtcatcagtaaggttttggaagaggtagtgtgcttgggttgggaaatttcatcaaaatatcagaaatccctatgtggaaaattctcattttcacaaatgttaaatgaacttctttcgatactcaagtcacaatagatttctttctttctttgattattgaaatgtttttcagttgttaatcctacatttagtccacattcagcattgggacatgtgttcgcaattgttcatcgtaggacaggacaacatggttggccttcatttttgtcttttatttcaagttctggggtacatgtgcaggatgtgcaggtttgttacacaggtaaatgtgtgccatggtgatttgctatacctatcaacccatcacctaggtattaagcccagcatgcattagctattcttcctgattctctacccaccccctccccgacaggccccagtgtatgttgttcccctccatgtgtctgtgtgttcacatggacacacttataagtgtgtcaccttccacttataagtgagaatatgtggtgtttggttttctgttcctgcattagtttgctgaagataatggcttccagctccatccatgtccctgcaaaggacatgatctcattcctttttatggctgcatagtcttccatggtgtatatgtgccacattttctttatccagtctatcattgatgggcatttaggttgattccatgtctttgctattgtgaatagtgctgcaatgaacatatgtgtgcatgtatctttataataaaatgatttctattcctttgggtatatacccagtaatgggattgctgggcactgaactgctattataacagtctgtcagtaggtcagttggttccaggatgaccttagagatcgtttcttatcacagatcttcatttgaaagtcattatgtcctatttcacatgagaagatgccattacgtgaagtgactgtcatcttcaagctaatagctggaccaatgttttggttcagaagtaaggcatgttggaatattctaaaagatacaagtcaggtcgtcagcaatgctctctgccttgggtggataccccattctttccccagcgtgcatctgagttttccctcatatcattgcaaatacccccatgttcccctttcaactctgagccaaacttagtaattaaccaagagttagccctttagtggagaaacaattctgcctctggcacaagagacctaaatgccccaatccttgatatcaaggagtttaggttctagggaagtgaagtcacaaacacatgaagaaatgtctaaccaagcagggtctctagaagggaccaccccaccccaggtctggtccaatcacttcgttgtccagtgccctatgatgttgttaatgaagtcttcaactgaacagtaattcatgccacaaaaacattaacaaggctgggtgtggtggctcacacctataatcccagcactttgggaggctgaggtgggcagatcacctgaagtcaggagtttgagaccagcctggccaacatggtgaaaccctgtctctactgaaaatacaaaaaaaaaaaaaaaaaaaaattagccgggtgtggtagcgtgtgcctgtaataccagctgctcaggaggctgaggccagagaattgcttgaacctgggaggtagaggctgcagtgagccgagatcatgccactgcactccagcctgggtgacagagtgagactccgtctcaaaacaaaacaaaacaaaacaaaacacattaacaagatcagtccccaaactggctttgggcttgtgcttccagtttatatataagttcctcagcagcagggtttacatccattttttctgtaactccactgccaagttcaagctgtgacgtgcagtagggagcccagggggcgtcggctgatgagctcactgcagtattgaagtattatgctgtcaagaaagtccactttccattggtctaattttgctttttattttttatttttcattttcaggtgtgcacagaggttctccactttgttttctgaactcgcggtcaggtgagtaatgctatttctatgagataatgttgtagaaatgaggaacatgttagcttgggtttttttttctttcctattttccctccttcattgcaaattcccatccccataccaactttattcttttttgtttgttttgttttgtttttaactcctcactcccacttggagctctcttttcttcagatactttcttttccttggggattctattgttgacctgtttcttcttgctaacccaattgcttttgaatgggcgttcagaaatgggtaccgattttgaagttacatggtgcggtcaaagctggggaaagagaatgatcatttacgtggaattatttgggattctgtttcactgttttcccctttcctgctccctggacgtgtgtcccttggctctaacagcttttgtcatgttttgtaatggaccaaggaagtgtttgttctctctctgacctaagtgctgtgcaaatgcagctgtcaaaggatccttccaaccagatttctgcccatgaccctcttctagatagaaattctgaagccgctactttcacgcttcctatttctttcttttttcttttcttttctttctttctttcttttctttttttttttttttttttttttttgagacagggtctccctctgtcacccaggtaggagcgcagtggcgcagtcacagctcactgcagttttgacctcccaggctcaagtgatcctcccacctcagcctcctgagtaactgggaccacaggtgcatgcaaccatgcctggctaattttttattttttgtagagacgggatctccctatgctgccagacgggtctcaaactcctggcctcaatccatcctcctgcttcagcctcccaaagtgctgggattacaggcctgagccactgtacccagcctatttcttttgagactcataaatagtggtatttctgggaattcattgacataaattatcaaaattttgtaaacaatgtaaatgtctatcataatgaatacaaattagaatgatcccattataacttacatgataaataacacattgttattataatagatactagtaagttattgctataaataaggttataacagctgagcagggtcacacagccagtaaatggcccagctgggacctgaagcaggaattggcatggtgtgatgacaaaaccaaggaagggcacagaatcctggcgaggggtgggccctggtgggtgaggcggggttggtttcctgagtccctcacttcctctccagcatggtttcctagatgaccgccaaccatgtgcttttgccctatccctgccccagccctgcagtgcagatcaatgccccaggaggcttttaagaagagcctcttatttctctcctctacatattgatagaattattttgcagcagtagattctggaccaaatcaatgaaaaaatctttgtcgagtgcctgctgtgggtgtgggggtgaggtggagatcaagcctatataggagaggctattgtgttctgcttccttgtttttgtttttaggcaaagtcgagtctgatggaccatgaagagaaagtatcttttgtttgttgttttaaaaaaaatcactattgatttggccatgccaatgaccaatgaatctgagtagtggctattaagctatcgagggcaggaaagatatctgccttgttttttgtggtatctcaagtccctggcatagaatcttgcttgtaatagaacttcaataaacattcgtcaactagatgaatgaatgtcaattattttggaaataattccaaaatctgtttacagtttgtactggagtgtattataaacttatcttctttagctgagtatggtggcgtgtgcctatagtcccagctactcaggagcctgaggcaggaggatcgcttgagcctgggaggtggaggttgcagcaagccgagattgtaccactgcactccagcctgggtgacagagcaagaccctgtcacaaaaaaacaagcaaacaacagcaacaaccaaaaaacaataaaagaaacccaaaaacttgtcttctaattatgcttgtaatcatagctaacacttcttgactacactaagactttcattacattacctcatttaatccccacagaaccctgtgaaataggtcttagcattacttccacgtcttcagatgaagaatttaaactccagagaggttaaggaacagcccaagtttacactataagtggtggagcttagatgtgaaggcagacagatggctctaccatgcatgctcccgaatcctatgctattctgctcattattgtgtgttaaacatactgcaagcattgggggcagaccctgaagaatgaggggagagagatgaagtaggctttcaccttgcgttggataattcacacatggctaatcaagagtatggtagatcgcaggtatgagagagtggagaaatctggagatgagcaagggagccaaaaaacagaacacccctcagccgggcgcggtggctcacgtctagaatcccagcactttgggaggccgaggcgggtgggtcatctgaggtcaggagttcgagaccagcctggccaactgggtgaaaccctgtctctactaaaaatacaaaaattagccaggtgtggtggcaggcgcctgtaatcccagctactcaggaggctgaggcagaagaattgcttgaaccgggaggtggaggttgcggtgagccgagatcacgccattgcattccagcctgggtgacaagagcaaaactccgtctcaaaaaaaaaaaaacaaaaaccaaaccagacaaaaagcagaacacccctcaccaggtttggtgagtgtatgtttacattaagcgcacaatttagttctaatcttgcacgtctgatattgattcacttgttttattgaataaagcttcctttttctgcatcagaaagcacttaccgcttattaagaaaatcatttttgcactgtaaagaccaaatcatttccttccatttgattctagagatgtgtaagtttcacactgcaatgatgccatatggctcagcattggctttactttgtgctctgacaaacaacatacaaggctgctgttttagagttcctattcagcacttaccagttaacctagtttctgtcatctttaggacatggttgtttttggcatatgggatgttgtttctcttactacggtaatactggctttagttcttggtgaccttatcttcaaaaaattttgttgctgaagttcagaatagttccttttgtccaatatttattcaaactacctcaatttacaagatttgaaattgcttctagacatttctgtgagcattttggagaaatctgaaaacagtctcatttgatttatataatgggcaaaaatctaaggactttccttgtctggttttggcatcggggttatgatagccttgtaaaagtgagttcagatgtgctctttttcttgagtttctgtgcgattgaaactcttattccttaaatatttgatagaatcatcagtgaagccatctgggcctggagttttctttgtgggacaagttttgagacttttaatggttatacctactattcatgtttaccatttccacttgattccttcttggtaattggtatttttttctagaaatttgtccctttctatctagagtttcaaaattattgaagacagtttttgctaagagccttttatatttattatgtttatagcatttacaggtgtgttgctttttccgtacctcttattagctacttcctcactccctgcctctctctttttctcccctttttccctcccctccctctgtctcttgattttgccagaattgtcttttcaaagagcaacgttggctttgttaatctttatgtcttttttctgtttttattatatgcttttttttttattaccttccttcttcttctttgggtttattttgctgtactttttcacacttcttaagaaccttaattcattaattttaagcctttctctttttctaatttgtatgtttaaaatataattttcactctatctttagctgtatcctatgtgttttatatacagtgtttttcttattgatcaagtcgaatattttcttttttcttttatcttttttgtttttgagacaaggtcttgctctgttgcccaggctgcagtgcattggcgtgatcatggttcactacagcctctacctccttgcctcaagcgatcctcttgcctcagactcccatgcagctgggaccataggcgcataccaccatgcccggctaatttttttatttttttgtagagatggagggggggtcccactttgttgcccaggctgggctcgaactcctgggctcaggtaacccttctgccttggcctcccaaagtgctgggattacaggtgtgagccaccacgcctggcgaatattttctaataaacattgtgacttctttgacccatgggttatttgttaaataacacatctaactttttgttattacaccttaattgtgttgtggtcaaagaacatgctgcttttctgttttccaattgtttaaaaagcttttgagacttttctgttggtctggatggttttcacagacattccatgtgctcttgaaaagattatgcgcgctgcagttgttgaatgggggcttctagatatggtcctcatgttgttggttaaatgtgtgattcaaatattctatatccttaatgactttcttatttaatttttaccaattgctgatagagatctctcattatgattgtggatttgttctatttctccttatattctgtcaatgctgtttggtgtattttgaggctatagtagttgcattcacatgtaaatttcttcagtcttcaattcagaattgaatcttttatgaatgaacggttttatttctaggtaaagtattttgctttaaagtataatttgtctgatattagtataaacacattaattttcttttgattagtgtgggcatagcatatcttttccatctctttactttcaaactttctgaatcattaggttctatttgtgtccttgtaaatagcatataattggagtttgtatttttttcagtctgataatctttgccttttaatggaatcattgagtccatttatatttcatgaatcattgatctgcttttttttttttttttttgaaatagagtttcactcttgttgcccaggctggagtgtagtggcgcaatctcggctcactgcaacctctgcctcctgggttctagcgattctcctgcctcagcctcccaagtagcctgggattacaggcacctgacaccatacctggctaatttttttttttttttttttttttttttttagtagagacagagtttcatcatgttgatcaggctggtctcaaattcctgacctcaggtgatccacccgcttcggcctcccgaagtgttgggattacaggcgtgagccactgcaccggcctgcatttgtttttaaatctttattactttctatttttcctaaccattctttgttgctgtttctcctctttcttgccttttttcagactgactgaatatgttagaaactgttttcctcctccactagttaggaagttatatgtcccatttctgttgtttagttactaaagatattacaacctgttgtagaaattacaacatgtctactcaacttttcaatgtgtaaagataatcaatacctttagcttcctctagtataatccaaggaccttgaaagactttaatttttgaatttcattttgtcatctccttacttatattacatataatgcatatattgtctcctatgtttatatatatgaggtagttgccatatgtttttattttatcatgtttcactaatccctacaagatgttattgttttatatagtagttttgttttgtttcaagacacagtctccttctatcacccaggctggagtccagtggcacgatcttggctcactgcaacctccacctcccgggttcaagcaattctcctgcctcagcctcccaagaagctagggttacaggtgccagccaccacatctggctaatttttgtatttttagtaaagatggggtttcaccatgttggccaggctggtcttgaactcctgacctcaagtgatctgcccatctcggcctcccaaagtgctgggattacaggcgtgagccaccatgactggcactgttttatatagtaaaagttcatttggatttgccagtagagagtactacccctagttctgggcacctggggcctctggcctgtgacttgtgatttagagtcccctctctggcccttctctagctccacccttctccaaatggcaagaagtctgtggcaccaagaagtcatgcctacccggagctacctccctcttcccctcacccttgcttctagatcgtactctgggaatccgggaccctggaattcccaatccaaacattctgtgccaatttccaggacctgggcactccccttcctcattgcaagccatgctgcaggtgtacgtacccccagacccaagggatgaccaaggggtacatgcatgcaggagagggggttaggggtatgcaggctgtggtgatcacatgagtgtgcacaaagcctcttacagcttggaatgaagccttaggggaagaataagggcaaagccttcttttaaactcttgatctgtatcttagaaatgttagccatgggcctggccacaaacccaccactttctttgttcctcattcctcctttcatctcagttcttatgtcttttgcctaaatacatgttttaggattgatttcagtaatgatttgcaggtagggaacaacatcacagtttctgtttgtctgaaaatatcttcatcttgccctcattcttcaaagatattttccctgagagcagaattctaagttggcagtttgtttctggcacactgcagatagacttccactggttctggcttccattgttgcttctgagaagatagctgtcagtctaacagcagcttcttaacagcctttttctttctttctttcttttttttttttttttttttttgaggcgaagtcttgctctgttgcccaggctggagtgcagtagtgtgatctcagctcactgcaacctctgcctcccaggttcaagcgattctcctgcctcagcctccagagttgctgggattacaggtgggcgccaccacacctggctaatctatatatttttggtagagacgggggttccgcctcgttaggcaggctgacctcgaactcctggcctcaagtgatccatccgcctcggcctcccaaagtgctgggattacaggcatgagccactgcatgcccagcctaacagctgctcctttgaaggttatctgtcttgtatttctgacaatttttcagatgttcctgtttttgtttttgtttttttttttcattttcactatgatgtatctaggtgtagatctctttttatttcttttgattgagattctttgggctccttaaatctgaggattggtgtttttcacccatttggagacacttagtcattatcattccaaacactgattctctctttgaattttgtttaaatgtatgttagacattgtatttcttttctccatgtctctgaacttttctttcatatgtcatatttgaaactcaggtttgcctcattaggcccatacccacaggtataagtgggcttcattgcttacattacttacctgggttcctgcttgagtttcacctttggcctggcaattcctttctatctggccagctctttgatatgtttaagaaaatgcgcagctgggcatggtggctcacgcctataatcccagcactttgggaggccgagccgggtggatcaactgaggtcaggagttcgagactagcctggccaacatggtgaaaccccatctctactaaaaatagaaaaaattagccgggtgtggtggcaggcgcctgtaatcctagctactcaggaggctgagacaggagaatcgcttgaacctgggaggcggaggttgcagtgagccgagatcatgccactgctctccagcttgggagacagagcgagactccgcctcaaacaaacaaaaaaaaaaaaaaaaagaagaagaagaagaagaaagaaaatgcgctgggtgcggtggctcactcctgtaatcccagcactttgggaggctgaggcccaggagtttgagaccaggagttcaataccagcctaggcaacatggtaaaacttcatctctacaaaaaataaaaaaattagccaggcatggtggtacatgcctgtagtctcagctactcaggaggctgaggcaggaggatcaattgagcccacgaggttgaggctgcagtgaaccgtggtcatgccactgcactccagcctgggtgacagaatgagaccctgtctcaaaaaataaataattaataataataagaaaatgcttttagcattttattcatgatttttaattgtcttcagcccaaggtttgatctaactaacctaacccaacatattcccggaacactgaagacattttttttttccctgagatatttcctgtatcgaagtcattgagcagtgttcaaatagaaatttaattatgcttttcttaccagtttcctgattctttttctgacttctttgagaattgaacaatccaaatcaactgctttttcactttttgttctcactttatccacactgagaacccctgcagtccttctctttttacatttccccttgtggtggtcttgtaagccaacatatatgactccgtataaatgtctcaaaagcatagagttttctagaagacttagggaacaattatcatacctcttataactcaggtcagaaatattgatcattgtctatatcatagtggctatggtataatcaaagtatgccagttaaccagagataacagagaataaccctcacacagacctgccctatggtggtatcaagctatttctccctttctaatattattctttgattattctatatctaaagacagatttatcatttattggcataacaggttgcactgatgatatatatttcaaaaatatgatactgatactatttaatgaaattgaagagctctagaacgagtttttagagtggaagcaccacggcatatagtcatgtagttcgtgcactgtacaactctagagggaggttgccatttacatcagagttcacaacctaaaagggggccctggataaagatgaattggggatcatctttaatctagtgtcaaggtctacgtttcactgtttaaatgctaccaaatagttttctctgtaattgttgctatcttcctagccatccttagcaccttaaaaatttactaagaaccagtggctgttcagatcctctttgttgatgacctggatagcattgagctaacccagattgcaccagaagatgaatagatgtttgtgttaggctgttcttgcattgctgtaaagaaatccctgagactgggtcatttataagaaaaggggtttaattagctcctggttctgcacgctgtgcaagaagcatagtggcatttgcttctggggctcacttatcaccaaggggatggcccaagctattcatgaaggatcctccatgatccaacacctcccaccagctcacacctccaacattcaacatgagatttggatggggacacgtatccaaactatatcaatgttccagctgaaaaagagaaaaatggctttgatgtgcaatgactaaaggtttcaaacttcacagattgccctttgattagtgatcctagagactttatgacctaataggacattctcggtttatgcagaaggcagtaggagctacattatttcaaataccataaaacttctccaaaaacatatgttcagccttgaggaaacgtattccagatctgacaactgaaagcagtctgcattaagttcttgatctatatatttttttcaagatgattgctggggtcatctttcattctggcctttcctacctgcatttggaagttgagtagatcctgcctgtagtgaaaaggcatagtttattttgatcagaggtctcagttacagcacatagtagtcactcactgtgtatgtacactgagtcactgagtacacgaatttgcctttgatcatatcttgtacaccacttaggtcctgccctacgagttagcaaagctcaagaatgagtctttagacattcttaaattgtataataacattttgaacttgatgtctttcacctgatggactcaaaacattttacttacaaggagacaaagtctcaggaggctggcattgtgttctggtagaaagagtaagggttctgccaaatagctgaatgaccttgacccatcccctagacttgcaggggtgtccaatcttttggcttctctgggccacattggtagaagaattgtcatgggccgcacataaaatacactaacactattgatagctgatgagttaaaaaaaaaaaattgcaaaaaaactcataatgttttaaggaagtttacgaatttgtattgggccacattcaaaaccatcctgggccacatgtgacccgggggccagggttggacaagcttgcaatgatgggacctctttcatctgtagaacgagggttcgaggataggtgatttctgagttcctttccagaaataaaccactctgatactctctccccaggctacacttaaatacttgtgaattaaatctaagtcaactccaccagtttcaggtacagtcaagcctatttgtagaggagagcattttctgtggcactgaagttcactcaataatgccttcattttttttttttaaagcagtgcttttggaggggggacagagttcaaaaactttaaaaaatgttaatttttaaactttttattgaaacttatggcatacatatatgtgtacaactcagtgaatttcgtgaactgaacacacccatgtaattggcacacagaatattctcggtacctcagaagcctcccttgtgcccacatccaatattgttataactccctccctttcaaggataacccttctcctgacttctcaccacatcaattagttttttctgcttcggtttctcatgaatggaattatgtacaataagcactcttttgtctctggtttccttggcaaacattatatttctgagctgcactgagattgttttgtgtagctgtagcagacacttagatctttcctccagagagacatcgatacatctttgcacaactgtgttaacatcctcatttgagtgactcctttgggaagatcaataacatgccattatgcccagagagaggttaaaagaggagggagaaattagaggctttttataattgattaacatattctagcattaatacataatacaatttattaatttaagatatgcaagccctcttctgaaggagaaagattcacctcctggtctaaaacatcatcatgtcaggtcaaggaaagaatcactctcctagtgctggttatgagtattcaattacagaattcttaaagattgccagctttaccttgagacagaaactctgacttataaaacccctttctttccatgccctccaccccttaatcccagcactgcctgatcctgcacatactaggtgcaaaatagatatttgttgaatgaatgaatgaatgaatgaatgaatgaagagcacagctaacatttacagtgcattcacagtgccagccactgtgcaaagatttcttgtttactcaccgcaacagcactatcaggtgggtgctgttgtctcagtttgctagatggggaaacatgaccattggaaataacttgtccacagtcactcagatattatggggccaagttgggacctttgaactcatgctctttagtcttcaccactgtgtattcacactcactctagggcttgcagaagctgcaagtggtggctggattcatgagtgcccttggccgagagctctgctagctgaggacacacagcctggtttgtcccagccacttccctctggctgtgtagagggagcctgcccagttggctctcgccacccccttgcttgtgcctgtgcccatgagtgattcctttctcagcaccccacgccagcctctgctcctagtgctgactgcccatcttggggtaatgttggccaactcccagacatgagaggatcagacacagtcttagcatttgcaattctttctgtgtgctgaactctcccctagcccctgccccacctccagcacgtgcatttcatctagttcactcctattcagccctcacatctcatctggtacatattggccctcaataaatatttgttgaatgaataaatgaatgaatggtaaatgaggcttttaaattcaattctgatataaactactgaaatgcaagcaatgatgataaaataatatgcaacaaaaaggaaatgcaatgtactgatgaaactggatagttcccttgacccctctgtgggattcatgaaggagtggctcgcttactcagcccacagctctcaacccctcgtgggagggggagcacgcaggtgagtgggtacagaggccaggttgagtgcttctgggcaaccagcaggagcaggactctgtgcaggcccacagcagcgtctacaggttgcccgcgacccccgagccccagagggcatgtgttaccgcgcattcttttagcattgccatccttggacagtgtaagtgttaaacagttcagtggagggtcagtgtgacagcctcttgcacctgcaccaaggtctttgtctggcatccaggagtaatgaagttgtaagaacaaattggagggtggtgaatgcagaggattttattgctgatgaaagtggctctcagtgggatgggtggctggaaaggggatggagtgggaaggtggtcttcccctggagttcggccatctgcggctgaactcctccgaagtcgcactgtcaagccatccctctgaagtcaagctgctcctctccaaggtccggctacttctcttctctcctctgccactctgccagtggggcctgggatttttatgggtacaggatttgggggcagggcaggccagggtggttttggaaaaggcaacattcgggcagggaaatgagaatgcatgttctcacttttggctgcgggtccaggcttgagggtgtggcccttgtctagggccacactcttctacccaatatttccctgcctcctgtccatatcacttatccttttacagtataaaacatacaagagcgaaactccgtctcaaaaaaaacaaaaaacaaacaaaaaaaacatgaataggagctgggcacagtggtgctgcctgaggcaggaggattgcttgaagccacagtatactatgatcgcacctgtgaacagccattgcactccagcctgggctacatagcgagaccctatctctttaaaaaaaaatttttttaaggaaaaatgacatagagaaggataattattgaaaagattctgtgtaatggtaataatgatgtaacattttgtgttttttattccttctcttgttattttgcatgtgttgatgttttccataaatccacatggactaccttgcttctaagtataacatcctactgggcaaccctcccataataaacatgggttttgcttgttgtcaccagtgcccaactggcgtttctgattctctggaaccatagcaatttgaagtgcacaggatcacaggttgccttggttgaggaatgacctttgaggtattgctgtgttgtgattatggcagctgtgatgatctgtcttctccttactttattccaggatggttttctctgtcaggcagtgtggccatgttggcagaactgaagaagttttactgacgttcaagatattccttgtcatcatttgtcttcatgtcgttctggtaacatccctggaaggtaatgtgtctgtttttcttcattttttttttttctgtttatctgcatgtgtgtatttttttgttatttaggatttttttactgtggtaaaataacataatatttatcattttaaccatttttaagtgtacagttcattggcattaagtacattcacaattttgtgtaactgtcactgctatccatttctaaaacgttttcatcatcccaaatagaaactctatatccattaaacaataactcccaatttccttcccccccaccccttcctggtaacctctgttcctgttctttctatgtatttgcttattgcaagtaccttagataagtggaatcatacaatatttgtccttttgtgcctggcttatttcacttaggatgttttcaaggttcacccatgttgcagcatgtatcagaatttcattctttttaacagctaatgtttcactgtatgcattgacccattttgtctattcattcatccattgatgggcatttgggtcgtctcccccttttggctgttgtgaataatgctgctatgaacatgggtgtacaaatcactatttgagtccctgctttcatttctttggggtatatacctaggagggaattgctggatcatataaccctgtgttgaacatcttgagaaactgctaaactgttttccacagtggctatatccttttacatttctacaagcaaggcacaagaattccagtgtctcccattcttgacaatgcttgtattttcctgttgttttggtaatgggtgtgaagtggtatcttattgtggctttgatttgcattttcttaatgattagtgatattgagcatcttttcatgtgcttattggccacttgtatatcttctttggagaagtgtctattcaagtcctttgctcagttttgaattgggttgtttttgttggtgttgagttttgaagttctttgtgtattctggatattaatcccttatcagatatataacttacaaatattttctcccattctgtggggtgtttcttccactttcttaatagtatcatttcatgcataaattcttttaattttatgtagtctatttatttttacttttgttgtctatgctttggtgttatatcaaagaaatcattgccaaatccaatatcatgaagactttcccctatgttttcttccaagaattttatagttttagctcttatgtttaggtcctttgatcgatttatcatttttgtatatggtataaggtaacggtccaacttcactctcgtgcatgtgggtattgttttccagccacatttcttgaaaagactgcctttttgctattgaatggtcttggcaactttgtcaaaaatcactttgttataccagtggagggtgtctaggtttttggcatcttgaacaaataattggacaaaacgcactaacaaagcaaggaaggaatgaagagatttattgaaaatgaaagtacactccacagtgtgggagtggcccgagcacaggggctcaaagtccctgttacagaatttgtgggagtttccattggttacttggtgtatgccctatgtaaatgaagaggatgaagtaaagttacaaagtcatttactcagcatacaccctatggtgaggatatttcctgtcatagctgaagtgtgaatcggccttatgttccctgcctccagaccctattttcctgcctcaaagtgaccgtatagatgagggtttatttctggtgtttacttgtttttaaatgtatctacttgaaggtacaaccatatggaaatttaaaggtggtagagaatcagacagatgaagcagcctggtattttcggaaagggggatctttagaagttcatggaacaagaagaaaaggcatctgagaaaagcagttgaaagaccagcaatgctgggcctgcaatttctgtgggcacaactgccaaaggcaagtgtaaagaatcctcattaggaggttcacacctgtaatcccagcactttgggaggctgaggagggaggatcatttgaacccaggaattcaagacaagcctgagcaacatagtgagaccccgtctctacaaaaatgaaataacatgaaaaattagccgggcatggttgcgggtgtctgtattcctagctactcaggaggctgagatgggaggattgcttgagcccaggaggcggaggttgcagtaaacagtgaccataccagtgcagtccagcttgggtggcagagtacaaccctgcctcaaaaaaaaaaaaaaaaaaaaaaaaaaaagaagcatcctcattaggaatgggactaggaaatgattgatacttaagacatcaaggacacacaacgaaataactttcttattcagaagtgggtggcaggaccaaggaatctttattgcataagataaaaatctactagcagcaaacaacaaaacatacaaacaaataaaacacacatacaaatacacagactaaatggaaaacttcccaacaagctataacacaattggcaatcctttaaaaagtaggtactggggcacgttgtcaaaaagccgccattctttaaagaaagaaataatggccgggtgcagtggctcatgcctgtaatcccagcactttgggaggccgaggcgggtggatcacctgaggtcaggagtttgagaccagcctggccaacatggcaaagtcctgtctctactaaaaatgcaaaaaattagccgggcgtggtggtgcacgcctataatcccagctacttgggaggctgaggcaggagaattgtttgaacccgggagcagaggttgcaatgagctgagatcatgccattgcactccagcctgggtgacagagcgagactctcaaacaaaaaataaaataaaatctaaactattctcacacgcaccatctccttagggcactgaaacattactgtgggcttggcagggcaaaactcaagagtccccactttactgatgagtaaatgtccccagggaggttattggttaggaagtggcggagtccagattagatgctagatcttcagtctcacgtttcggtgctttttccaccacaggggtagatgaggcaggaaagtggaacacaagggaaaaaattcatccaaatgaaagctgtttgttagaaatatgtctttttgaaaaattatgttttaaaatgccaacaacaggggcaggtaaataggaaagtgcatggctctgaaacaaacctaagtagggaaaagctgagtgatcactcaaggcagctgactgcatttcttgctccagatctctgatgaattgatttcttaaagcagtggttcccaaagtgtgacagacaagtagcactggcatcacctgtctctcagaacgcccagtaagagtatttattcatgttatttatttattttgtttttgtttttgtttttttctttttctttcttttctttacttttttttttttttttttttttttgagacaggatcttgttgtcgcccagacttgagtgcgcgatctcagctcactgcagtctcaacctcccgggctcaggtgttccttccacctcagtctctggagtagctgggactgcaggtgacatcaccacgcccaactaattttttaaattttttgtagagatggggtctcgctatattgcccagggtggtctcgaattcctgggctcaagtgatgctcccaccttgcttcccaaagttctgggattacagatgtgagccaccacgccctgctcatgttactgaataatcaccttgatagcactcaccatgtgccagccactgttctaagcccttacaaatggctaattcatttaaagcccactctataaccccttgaaaaaggcactattatcagcttattttacaggtgaggaaattgaggcacagaggagttaagcaacttgccttcggtcaaataattaagaggttgcagagttacaattcaaattcaggccatctggctccaaagcttgtatgttggacctctatactatggtgccttttcacattcttaacctctctgctatgctaggctcagttgcttggtagttgtgaatctgtagattaaaaataaagatggaatccataattgtgagaatcaatgttgttctggatcacccaggtggttcataggcaccgcctcctccaatagctttggactggggcaggggttcttttagttcaggatggctcaggcctggtttttgaaggccaaggggactgacctgccacttctccactgggttatcaattgtgcgataatgattgcctgctgtgtgcccagcagtactggctgctgagaacatcgtctctgactccagggaattcacactgcagttggagggccgtgactatgacgcatgagaacaatacaaactataagtcttaaagtatgagtcagcgctatagggcactcacatatggcctgtggccagatctgtggattagtctaattcgatgctaagccacctatagcagatgctattggtgccctgcctatacccccttggcccaccccaggggtcacctgcagacagttcctgtggatgcttacggctttcatgtctccctgaggatcatctatgtccatgggagtgtgcttggcccatgtgcgggacaaaccagaagtgccagggagataacacccccaaacagtgagtaatgggagttggtatttaaatatgccagcttccttgtcccttggtgggaccacactcagatgtgttctatgttatctcccagagttccccagttgcattgtaccccataatactcatctgctcatgaatgtgcccatttccggattcacccccttgtctgtctcacttgcatattcccccactctgcttctggggaccctccctattgggaaactccccttccaaagttgaggccaaatcttactacctctagaaaacctgccctgacctcggaagaattaaatccccctccccagtgcttgcttctctttatccatccatacctggggatatcactttgtgtcacactcattacgggcttcctttgtactgtgagtccttgcagtgtgcggtcagtgccagacaaaaggttggcgaggcgggtggcgaactcacgggagggaagctgatgggcactgagagcctgctcagggccactcttccaggtgctttacgcacattatctcatttaatccttacaaaacctctttccggtgggtagttttcatctcggtttacagacaaagaaactgtcaaacaaatgaaggcatttgcctagaggtcccacagctaggaagattccccatcagaatctgtagcctgtactactcacacgacaccaggctgcccagggcaccctcagtaagtgtctggggactgaatgagcatgtcactgaggtgcagggctaggggagtggagagggagcctggggtgagctgttagagagcagcagctcccccgacccggggctctgggagatctggaccgtaaacacagtagcttcaccctggaagcctgagaggtgactcagtagctcttgacggcagggagaggtgggatgacactctctcgtcaggccactagccaacagagagagcccgtggaccttaacactttcagttgtgtgatttggtgacatttgaggggctcattcttggtctaccagaatgggttttggcacctccagcctccagctctcctgggcggtaccaatgcctttttttttttttttaaatctttgaaggaggtcttcttttagatacaactattctattttccagaggggcagatgacataatagtggaagatggttataatttcattcttgcagagttgtcttcctcatttggaaacaattacacatttgagccagtttggtgatctcatgagctacaatccccaactttctctctgggctgggtctagatctttctgtgctgcaggcatttccagcgatgagtccctctataattcccctctctgaggcctggctgtctgatttcctcctatcctctcttgctgtgttcacctgagtccttggtcttccttgcgaggaagtcggtagagctgcaggaaatgggctgcgtgctcctgagaggcgggaaacctgttctgtttcattttgtcctctaataccagaccctgtcctggtctcctcattctctctcaatcccctgtctgtacaaatgaggttataaatgcttaccatggcactgatctgatgctcagccaatctcacaacccccactgacccctgccaaatcttactacctgcacccaggcatgaggccatgtctgttggaccctggctctttccctagcaggtggaagtggtgatggggagtgatggagagtctatcatagataggttgcaggggaaactgaaagcagagggcattgtgtcccactctccacttggaactccaggtaaggactccttatgggccctgtgtgtcagcacagggcagttgcagagatgaagtggcaaaactgtttcctctgggagatgatgtcccctccaagtctctctcagctctcatgtggtagagtagggactctaaagtaccctcatgttcttagtgggtagctgtgatgagatccaggggtggggacagggctgcaaagactatggcatggacagcctaggccaggggtcagatggaggatgagacagacattcagtggtgagagctcaagggagctgtattagcaggagaaggaccccccaggcctggatgggattctgaagaatagaccatgggcccactggacacagccttcagcagtggacaccagttggatacccaggagccctgcaggatgagggaggtctctggagaggccattgagaactcagggctcagcactgggtgagctcacagatccaggccccttctccctgctgccagaaaggccctagcacgccattctcagcccaggcgccatcttgactaccagaaagaaaaggagggtggacaaagattgtgcatttattcacaagtcattgggttaactagagaccattttagagcaaaagagacaaagctaccttaaatcatcagacttaaggatctctttcctatatttctggagtggaggctctgaaacaaaagggagccaccctagatatcaaaggcagctcaggaatttttggtgtgttttggtgctattgtttctacatctaaattgtatctataaattttaaacttgctttaaaatgaatacatattgaacacagaatgatgtgtcagggcactccattaggaattgtgggaggccatcatcatatcttgaactctgatcctcctccaggttttatcttttcaggtatgtagagacatcattcaggtcctagagggtaatggtgacatcttttctctctttgtagcctccatattttctagcacatagtaagtactcagtaaactgtggttgtctaattggtttcgatttgtgaccctagtctaaagcctagagatattccaaaaagtgggccccccctcagcttacatcagcagtactatgctcatccgaacccagtcagttctgatacagtgtagactactccaaacttctgtatagacttcagtgaggtggctgtaccttggctaggattacccttgaagaatggatttcccctcctccatatgaggaaggagctcaactgattccccgttaagattccttcacagtctgacattctgtgagttcaatcagccagtagggaccatcttcagattcttcattcattgtcctggaataccagggatcctcgaacattatgtcattctggaagtccttgggtgatgtctgagctgctgattatttatgccaggttctcacatttgggtgcacattggaatcacctgggggaatttaagaacacctgcctcggccgggtgtggtggcttacacctgtaaacccagcactttgggaggccgagccacgtggatcatttgaggtcaggagtttgagaccagcctggccaacatggtgaaaccttgtctctactaaaaatacaaaaattagccgagtgtggtggtgggcacctgtaatcctagctattcaggagcctgaggcaggagaattgcttgaacctgggagcagaggttgcagtgagctgagattgcaccactgcactccagtctgggcaacagagcaagactccatctcaaagataaaaaaaaaaaaaaaaaagaatacctgcctcctacccccagagattctgacattattggtctgggggcacagcctggatattggggttcttcaaaataccccaagcgatgctagcagaaccgagaaccactcacctctgcaatcccattttaaggctgttctcctgttcaaagtcctaatgtgaaattggaaacaatttataagtcacattttttcgaactacatttattatgtgaggcaatttcaaaggcttttaaagttataacaaagccagtaatctcttgatttcaaaatggataaaagctctagaagtggctcttgccgactggcaaatcccccaagttatcgttgctgtccttgccttgctcttcattgaagaatcccagtgtctcttcatagtatcttatttatttatttatttatttttctgagacagagtctcgctgtgttgtccaggctggagtgcagtggcgcgatctcggatcactgcaacctccgcctcccggcttcaagcaattctcccacctcagcctcccgagtagctgggattacaggctcgcggcaccacgcctggctaatttttgaatttttagtagagacggggttttgccacgttggccaggctggtctcaaactcttgacctcaggtggtccacctacctcggcctcccaaagtgctgggattacaggcatgagccaccatgcctggccttcttcatagtgcctttagtaccagtactgtgtatactaagacagattctttagtactactacatagtactggtactaaagacagattctttagtactactacatagtactggtactaaagacagattctttagcactactacatagtactggtactaaagacagattctttagtactactacatagtactggtactaaagacagattctttagtactactacatagtactggtactaaagacagattctttagtactacttcatacatagtactggtactaaagattaacaacagcagcagcaacacaactggacactcctgtaggtctttgcggttgacgaagcaccttcgcatacatcatctcacggtgtccccttgaggttagtagaaaagtttgtgttatcctcactttgctgaagagaaaactgaagctcaaagcaatggagtgactttctaggttacccagaaagaaacagtaccaagatccagaaagtgcttatttttggcttggacagtttgggtaatttccaaattcacacagctggaaagtggaggtggtgagattctagaactcgtgttcttaaccacttccccaatatttagtcctgaagcattaaaaatggttttcttgttgttgctgttgttgttttagagcctgggtctcactgtgttgcccaggctggaatgcggtgcctattcacaggcgcaacaatcatggctcactgcagcctcgaactcctgggctcaagccatcctcccatctcgacctcccgagtagctgggattacaggtgcatgccaccgtgcctggcttgaaaatggtttttacacaactttgcatgatttgttcatcctgggatgaatttatatccccaaagcactgtataaagataaagagtgatctaaggcataaaagcaacagttctgctgatttaacctattagggtttaagttgatattccaagagaacacgctgttgaaatgcaccttaatagcattccttagttcaagaaataacaagaaacacattgatcttgccaagaggcctcacatttacaagatcacagggctgtaaaaaacatcaaggtaagttagagatacttttgcaatgatgtttgtgatgtgatgtgtgttagtctttaacatccgtgtccagtgtgacctatacccttttgttacttttcttttagaagtgaacagagcataaagtaaaagttactctaatgttgctatagtatttagtacagcatagagttttttaatttgaagaagagataaacaaagatataaaatggcagtaattttgctttagtgtgtaaattagaattgcttataattatctgattaattgaatgaacaggaattgaacacatagctctgttgtctttcaattatgtagacatttttgccttgctcctaacttgaaatatgatttgatattacacagattgggattcacagtgaagtctaaccaattctgggttttggtgtacacaagcagaaggagatgggtttgaattagtgagaagttttcagttacaggatgttttcaaagtagagttttaaaactttgaagtgagttgcataatatgactagaatgtaaactctctttgaggccagggactttgttttattccctgctataacccccgtgcctggcacacagtaggccttcaaaaatgggattaaaagaataaactttggcaaatgacttcacatttctgagcttgtgtttcctcacttgtggactgaaggggttggactattttggtatctggtattttccccacccatgacctattttgtaattcttttcttccagtgaactccaagccctaaaagatgcttttgcacaatttatttaagtaagattgttctcatttttggtgttgagtaaaaacatatatgacagtatccagtgtttgtgatcagcagtagaaaaccagtattgatataatcccaaacggtacaaacattatactctatttttattttatttttattttttagagacagggtcttgctctgtcaccaggctggaatgcaatggtgcaatcatagctcactgcagtctctaacacctgggctcaagcgcacctcccacctcagcctcccaagtagcttggactataggcatgcaccaccactcccagctaattttaacatgtttagtagcgatgaagtctcttcatgttgcccaggctggtctcaaacccctgggctcaaactcctgggcacctgcctcggcctcccaaagcactgggattacaggcgtgagtcatcgcacccagcctcagcctcacactctaatttttgtgtgtgcagcctattgtggataaataagcgatttttgaaatgatgaaagtaccgtctaaatgactacctttgcaaaacgtacagtattgcactaggtcatcttcaagtctcctttacctctgaagtggatttctatgaacttcagtttcctgatgtgtaatacgaagggatggaaccccatgatctttgtaggaggtgccttcctatgatgatcctaaactatggaaacttgaattagatgagcacagtgttctaacagacattctcactaacctagtgttagtgaataaataagaatgttttatagtcagaatggaaatctcatgcatgtaaatcctggaagaaaccatcttcatgattttttaaaatgccctctacaaattactgataccacattgtttgcattaagtgagaaaagtagtttattatataatggtaaactttatccaagggcacagaatcatatagtctgaattaataataattacaccttattgttgaaactgtgataaaatgcttgataaatgtaatataatttcattcaaagaaatcactcccattttacagataaggaaatacaagcagaggaatgttagaaacttactcaaggcagagccaggatctgaacccaagtcagtctccttaatcacatttaaggcttggctcagcaggcatgttcatttattcattagaaataaatgaacacagacattttattcatatgtaggagattaccaaatcagagttacagattattaaaagtgagggatctcagatcaaactttcaaagctcatgacaagccaaagaaaataggaggagaagacattattagaacaggagctaccaatgtataaaggctggctaaggattttctgaaggttaagggttaacgtggcttcaaaacagaggcaacttaaaaatacaatttttccaactaagtaggatttctatgcagcaggactatgcctaattccaaccctcttaatggttttttactagcatgtagttgtttatagaactagttcctcacataggagtcccactttcaagggtcccggagaaccacgatatgaacattcgctaggagcaaagctgatagggtgagtcataaagaaggggctgttcatattcagcctcaaagtggcaaggacttctcctcctcgggttcatgctgactgcctgacttttgaccttgtcaatatcatgacaaagaacaagagagaaaatggtggctggggagagtgattttagcattaatcttgtcccacccttagtttaatgggcattaattacttcacagcgctcaaattaaatctgatgtggcagagactggctggcaccaaagcttttactttttcttcctcagcacacagctaggctacatttcccaacctcccttgtagttagaagtggccgtgtaactgagtgctggccaatggatgtgggtataagtgatgtgtgccacctccaggcctggtcattaaaaatctcccacctggccaggtgcaatggctcacacctgtaatctcagcactttggaaggtcaaggagggtggatcacctgaggtcaggggttcgagaccagcctggccaacatggtgaaaccctgtctctactaaaaatacaaaacttagccaggcgtggtggtacaagtctgtaatcctggctacttgggagactgaggcaggagaatcacttgaacctgggaggcggaggttgcagtgatccgatattgtgccactgcactccagcctgggtgacagagtgagagagactccatctcaaaaaaaaaaaaaaaaatctcccacctgattcccatcactctctctctttccccgtttgcctgccgcatcgtgctctccagagcaaacttggaatctgcatctgacacatggtgagaactcagtaaatactagtaattatcactatagaccagtgctcatagaacatttttttgcaataacggaagtgctctatatctgtgctgcccaaaacagtggccaccagccacatgtgaccacagtattgagcacttgaaacttgactggggtactaaattctaattatgtttaactttaattaatttaaatttaaatagccacatgtagctaatggctaccatgttggacagcacagttatagaccatttaatctaattgcttcagaaggtttctatctcaaactgtgtaagtcaggattcaatcacaggagaaccactaaggtgcgtgcacgcgcgtgcgcgcgcacacacacacacatacacacacacacacacacacacacacacacaaagggatttgctacagggatttgtcctaatacaactgtgggagctggttaagcagtctctataaagctctcatcttcacatctgatgttgggactcgacatctatcggacaggcagttgggaaggaaggataaatgtaaaataagggagagcaagaacaacctggaaaccagaagcatgcattgtagcccacgagaacagactgagccccacgtcgcttattgttgcttttgaccttggcagtatggatatcctgcagaagctgggcgcttcatcataaagtacacacatggccaaggagccgaagaagctgaaaaggaaaacccaggagaaggtggagcagttacaggccccgcacctccctggtcctaataagatgaggcaactgatcattgccaacctatgtgagctacaacatggctgctgcccacatctgcccagatctcccacaggaaactctcttctgtcccacgttaattagaaacatgcaagaaagggaattttgggaaatgtagttggtctaacgaagatgatgcattatggagccaccacacatgctagcatgctaatgagctcaattttctatctgctaatacttctaaataaaacatgaagctaacatctcccaaggctctgttttgttgtttcagttctgcaactggcctagagaattctgaagatccttgcagccagctaacgttatctttgagtggtaagattaggagtacttttcaagtttttccttatatttttctgtggcttagaattcttcccacataaacccacattatgattgtaatcagaaaaaaattagttactttttagaagccagcctgtgacccctagggagaccatgcatcccacttaagggcaacccaataacatcatgattaactgtgtcttctacattcttcctggaaatttcacctgttcttgactttgtacaagaacttataaaacgtaagttatggtcatcagatttcctgaagccctctgcttctctcctcccatgttctcaaagtgatcccaaggatattttagaaactggaagcaaataatataaggagaaaagaaactggagtggaagtcttgcacgtagaagggagaaatcatttttagataagtcactgggaaagtgaagaatagagagcgcatccttgatatggtttggctgtattcccacccaaatctcatcttgaattgcagctcccataattcttacatgttgtaggagggacccggtgggagataattgaataacgggagcggtttcccccatactgttcttgtggtagcaaataagtttcatgagatctgatgtttttataagagatttccccctttcacttggctctctcttttgcccgctgccatataagacatccctttgctcttccttcctcttccaccatgattgtgaggcctccccagccatgtggaaatgtgagtaaattaaacctctttcctttataaattacccagtcttgggtatgtctttatcagagcgtgaaaacggactaatacagtcattgtattaactactgacttgagcagtatttactgtgtattcttctcaatactttaacagtagtacctatgaagtatgtcctgttacacttatcttcgtgcctgtttttcacctgggaaactgaagtgcagatgggttaagtaagtggtcaaagttacatagttagcaaatggcagagccaggatttggacctaggccgtcctggtctttggagtctaggctcttaacctacctgccacactgccttctttaggggtgcaggacagggtcacgtggactatgggagttcgatagattaactgctggcaggccgattcctgtttcttcctcactcccacatcccagtgaccccccctccgccccgcaaaatcctctcacttttaccttagtaggatctgttgaacctctcttttcatgccagcttcccaagcatgggttcaagtcctcatcgtgtcttgcccaatgtacccctgtagcttactctctggccttcccacttcagatttccttcatttatttcatagttatacaaaaaatattgttctgtgtcaggaacaggggcaagggggaagggagaatggggagttattgtttaataggtatggggttttggtttgggaagatgcagaagttctaaaaagagaaggtggtgatggttgcataaacatgtggacatacttaatgcaaccaaactgtacacttaaaaatggttaagatgaggccgggtgcagtggctcatgcctgtaatcccagcactttgggaggccgaggcaagcggatcacctgaggtcaggagttcgaaactagcctggccaatatggtgaaaccctgtctctactaaaaatacaaaaattagctgagctgagcatggtggtgggcgcctgtaatcccagctactagggaggctgaggcatgagaattgtttgaacctgggaggtgtaggttgcagtgagccgagatcgtgtcactgcactccagccagggcaacagaatgagactccatcttggaaaaaaaaaaggttaagatggtaaattttatgtgttgtatatacatatgtatatatatataaacgtatatatgtgtttatatatagacataaaaacatatgtatatatgtagcatataatttgtggttttatatatataaataatatataataaatataaaaataataattgttctgaaatgtaccttaaaaagcctctactgcatctccttctccacaagataaagcccacatttcttagcatagctttcattacttgatcatctggctcatgtgccatgcaggactgtagcttggccaccatctttttgtgccgatgactttgtgatcaaccactcctctttggcccttctcctggaaagaccccatagaactgagagctatcattcagccttgccgattatcatggaagtagcaggaatgatgggttaataaggagatagacttacagacagcctctcaggtggccagacagcatagagtgaatggagatggtatggcttagtgaaagaggtatgggctctcaagtcaaacaagtctgagtctgagttcaggcttaccattaaactctccatctgtgaaatgaggatgatcgtttcctattgtagggctattgtgaggattattagcaatcatgccccagatatagtgggtattcaatataagatatacagtgtgaattctctttagctcagactcagttaactaagtttggaaagaaagacatgggtggtattccagttatctatttctgtgtagcttaatacaactgtcatttagtttgctcacagatctgtaatttgggcagagctcagcaggagggctcattcctagttcacatggaatcaactggggcatcttggctgagggctggatcctctgcttccaggatggcctgtgcacacatctggcaagttattgctggctgttggctgggagctcagtggaagctgaggactaggaacctcagttcccatgtggcctctctacatggcctgagttctaaggataagagagagggagaaagagagagagtgagagcaagcaggcagaagctctgttgccttttgtcacctatcctctgaagcccatagtgttacttgcaccatattctcttagtcaaagcccacccaggatcaagagaaagggacataggttctacctcttgacagaagagtggcaaagttctggaagaacttgtgagatgagaaatattgctgtggccattcatggaaaatgcagtctgccaccaggagttttcagcttctaccttaaggctttggacttggaacccatagggaagtgatttctgaggtttacagagtgtcatggggccgggcgcggtggctcacacctataatcccagcactttggaaggccgaggcgggctgatcacgaggtcaggagatcgagaccatcctggctaacacggtgaaaccctgtctctactaaaaatacaaaaaattagccgggcgtggtggtgggtgcctgtagtcccagctattcaggaggccgaggcaggagaatggtgtgaaccaggaaggcggagcttgcagtgagccgagatcgcgccactgcagtccggcctgggcgaaagagcgagactctgtctcaaaacaaaaagagtgtcatgggcaccatgtgcgacatggaaccaggaggtgggggacatgagttttaatcgtatcaccacgcagcagtctcctcttacacaaagcactcacctggagccctggacttgtcatttgtaaccagatgatgccctcttcagctttactcttctccagttctctgagactgtgaggtccgggcactgtccattccaactccgacatgtcagccatggctgaatcagtgcttctccatccatcttcttttcacatcggaattgctagaggagctgtcaaaaatgcagatgcccaggttgaaatgatcaggggtgggatctggacatcagtcatttaatttaaaaaaaatttttttagagatgggttcttgctgcgttgcccaggctggtctcaaactcctggcctcaagtgatcctcctacctaagcctcctgagtagctgggatttgaggtgctagccaccacgactgactacatcagtaatttccctgggggtgatattaatgtgcagccagggttgagaatcggtgagctccgccattgtgtccatctaagtgtgtacaggagtcaatcaaaggaacccaagtgtagccattgcttttcgtgcccctgtgacatccttttgagccatctatgagaccagccacagaagaggtggacagttctatgctcgcagacttctgtctgcctctggggtttcccccgagccctggcagcctgctcagctgtcacaggaagagcccaggagtgcagaggaagtaatggcccaggagcaaatgtcaactgttggggagggagacttggataaatgccccagtctccagcccttcctagagacaattctagaaggcattctctatgcttctcagaggtctctttggacttgagctcccactgtccacaacaaacaccccaaacttggcttccatccttccctgtctctttctccctgcctcctgggattacctcccaaagaaagtacttgcactccagtcttgatcttaggccctgcgacccagagaacctaaactaagatgccaagtgatcactgctcaattgtgaactggcaaagagtggtgtgaactaagggaaattggaaaaactgctcgccacagccaaaccactggtgcacgcacccctgccacctttccaggcacttctgcacttaaaactcccacaagcgactcttgctaacccatacatgacagatgctttgatgagaaggaaagtgtcagctggctagcagcagaatcactctagacactagtggagttggggaggagagggttctttcttcacactctatcttttctggaggaagcagagataaccctacagcaggggtgtccaatcttttggcttccccgggccacattagaataagaagaattgtcttgggccacacgtaaaatacactaacatgatagctgatgagctaaaaaaaaaaaaatcacaaaaaaatctcatagtgtttcaagaaagtttatgaatttgtattgggccacatgtggcctgtgggctgcgggttggagaagcttgcctaggtcatgcattctcagtggaggcgctatcatccccattggggtggaaaattggttcttggtagcaaaacaacaacaacaaaaaaaaaaaaaaaaaaacacaaaaaacgcttatatatgacacagggccaggactaggatgaggcaagtcaggggcccagggaagaaaatattaaggagacagccactcccagggctgtggatgtccgcatatggataaacatattaactcgccagatggcaacgagcctgtgcataaagagatgaaaaggatcaggcagaggcagaaagtgttgcagtttgaaatagactggtctggaacagcctctcggagaaggtgacatttcagtaaaatgtgtaggaggctctgtagcaaaccaaggggccttctgggggaaaagtgttccaggcaggtggaacagcaaaggcaaaggccctgaggtgggaatatgcttggtgtgttggagaaacggcagggaggccaggatggctgagtgaggggagggcaggagaagataaggttggggtagagagctgtctgtttcatggaaatgttggggcgattccattgagtgaggagcacaggtataaggccagtgtcatcagtgtccaataaaggtgagtcggcctcccgctttccccactcccaaagcgctaagcagcatttacatgtcgtcagactgaaatagctctagaagctaccagccttcggaagttacaccaatcacttcggaagtgaacagaaatcatggctagcattctaaatgaaaagcacagccatgacgctccattatcagcacgggccaggaccagcagcgtagattgctagccatgtgtctagtttcagaggcactgggaagggcggggaatgatcccccagtatcctctactggtcagaaagttaatttcaaggctctcattcttcctaaagtacacatccctcctggtggagcacggtggacacccagtaggtcagtggcccttccttctcttcagcccacagcccaagatgagaagcggcctggtgtagtgaagctggagagcctgcctcacatcctagtctgcccttttacatgtaatcttgggcaagttacttgactgctcttttcctccatttccctatctgtgaaatggggataacgtacctcatagggttgttatgagggctaaatgagctaatatttacgcagtgcccggtcatatagtaatgctgtataagtgcttgttaattaaagatagaccccctttgggggctctaatcttcccaggaaaaaatgcatatgaacacacatttgcattttatttcggggcatttatggacgctccaaaatgcatctcgtggacccttggggaagggacagttcataaagccctgagagaaccaggatgagttctggagggatcaagagccagggggatgggtgggcgatactgtgcgaaggcaggagaaaagcaagaattgggggctgggggctcaagaacacatttcaccttcttcccgttctggccaaagcccacctagaactgcggattgcttgcactttgggaagttccatcagctaagagccgaagttttttttaatgatgtcattattaatcatttaataaatacattatgtaagagtacttattgagcagtgtcccagcgcgagtaaacatgttttggatatgccaaattagaaatgttttcattcagttttgggggttatgtagtaaactcggaaaatgccgttcctggaagagtgtctgttatcccaagcccttaagagccagtgtaataacaacaaaaatattgttctgtttggggttcccatataagagtgcctaggcgtggtggcttgtttttaattatctctctatggaacagtaattcaatccagaggaggactgccaccagattacaagtttcagttgggttgaaaatattcatgcaaggagagctagttgtaatctttttagatccactcccaaaagattaagcctttttctttcccatccaacttggggaagaatgtggtggaagtaaatactcatagtagtaccacaatcataggtgtaagacaaccatctcacatttgaagtcttaatatctaccacggtgtcaaatagcagggagaaaaatgaacacttcagaaacacccagacatgatcttgcataactttggtgcaggtagtttatttgggaggtgatcccaggaatcaggagtgaaggagcaggcattaggaaaagagagaagggagaaggcattaagaaaagaggaaaagtcattaacaggtatgttattgaggtcaccactgtaggcaatgggggctcacaatggctgactttttaatgctgtttttgatatgtatttgggtggacattttagcatacatttgtaagacctgttaaggcatctatctgctgtgatcggcagctataactactcctccaaactttgaaatctgagtcatagtcatccaagaagtattcttgagtctttgctctgttgactctgcattagtcattttgccttgttactttcagatccattccccatccttcccttactctgtatcacagggacctgaccccttgcaatatctttcatgtctccttgccaactggcttccagctaggttcggccagtgggtgtcagtgacaggagattggagtgcaagaggaaaggggaagtcagggtatttctccccctctctcggtttggctggcatctctaatgggggctgtgcctcttccatgattccagtctcactggacagaccccttccaacatcccgtggcctgaactcctgccttgtggctctgttcatcggtatctggtaatattacctcccccctttgctcttccagaatcttcctgctgttgctcacctctggattgctccagttcttcatctttgcaacatttccctgtgttacattcctgctcttgaactacctgtcatgggttcccaactgatctctgactgacggagatttcttaaggatttcattagtcattgcaaaaatattttaggacatcaaccacaaacaagacactggactagattcctggaaggtaataaataaagcatcaagcagcttagcgtctagttgggtaaacaaggcacacagtggaaaagttaaatgacatctttccaaatgccaagtgaaagaagggcgtagtcaatgaatacttgaagatataaagaggagagagccagctccatcagcttttgtaaccagggcatgctttagagggccagggagccgacataaaggggtcatctcccaaaacttacaattttgtaaaacaaggtgaaaaattggaattttatttgaaatttcctgatttttaaatgttggtgagtaattcaaattttcagtaacttggagctgggcatggtgccacacctctgtagtcccagctactcaggaggctaaggcaggaggatcacttgagcccaggagcttgaaacccccatttctgaaaaaattttttaaaaatatccaggtgtagtggtatgtgcctatagtcccagctactcaggaggctgatgtgggaggatcccttgagcccatgagtgggaggctgcagtgagctatgattgtgccactgcactccagcctgggcaacagagcaagaccctgtcactaaaagaataataataacaaaaaactccagcatgattcccactatgtagacaagataaaacttgtttggaggctgaattgagactgtgggtgtacaattggtggatggattactgtatgggggaagaaatgggatgcagagaatgttaggattccttccaattagaaggttctaaggttctaattttacacccgggtatgaggcagtgacggcctgggtatggaagggggcagtgagcatggggagaagggacagatgagagagagattaaagaagattaataataaaaccctatggccaggcgcggtggctcacacctgtaattgcagcactttgggaggccaaggcaggcggatcacttgaggtcaggagttccagaccagcctggccaacatggtgaaaccccgtctctactaaaaataccaaaattagccaggcgtggtggcaggttcctgtaatcccagctactcgggaggctgaggcaggagaatcacttgaacccgggaggaggagcttgcagtgagccgagattgcgccactgcactccagcctgggcgacagagcgagactctgtctcaaaataataataataataataataataataacaacaccccccatttctgtattcgattatggtctacagagtttgtcattggaactgggatagagtagagcctcagaggttaggctcagaagtcaaactgccttcgttcaaatctcaggtctacaagcaatgatctgtgaggccttgaacaagtttctaaacctcacccatcctgtttctcaagcactaacaaggaatgatgttaatgatatcacctacctcttcagggtcgaggagtccttctcatggcataactctgacccactcttctgcctgcctcttccacttttaagaactcatggactagattgggcccacccaggtaatccaggataatcgatccatctcaggatcctcagtgttcatcacatttgcaaagttgttggctgattaaataataaagtatgtttgaagtccttcatgtggtaagcctggatcacaggaagcgtggatcagtttttgctattcctgttatgccatgtacattctctctttgagaatccttgcaacagccccatgctacaatgagaagactgcccaggatgcaatgactggatatggaggtgggagttggggatggggaggagtcaggagcaatggccagagagttagcatcttggtttgtagactcgactctattgttaaaagtaactctttgtttctgggctcttcacttgacccctgtaggattttctctcttgaagggcggttccttgcaactcattctccataatttaggaaactgggtttctgagtatggtggaaagactgatggctccccaaaaatgtccacatcctaaaatccctggaacctgtaaatatgttaccttacatagcaaagggaactttgcaggtgtgattaaaatgaaagaccatgagattatcgtggactacttgggtgggcctaatagctcttaaaagtgaagaggagtcagagtgatgccacctgagaaagacctggccctgtcccatcatggctgactttgaagatagaggaatggggcatgagccaagaaatgtggggggcttctagactctgggaattgaaggaatggccctcaatgtattgctagcaagaaaatgaggaccttggtcctacaaccacaaggatctgaattctgcttatcctgaataagcaggaaatggattctcccctagagtttccagaaaagaatgtggcctagcatcatcagcattgattttaatctggtgagactcctactggacgtctgacatgcagaactctaagataacaattttgtgtttgaagccagtaagttaatggtacagcagcaacagcaaaccagtactgaagttttcaacttaaatgtttggcgggtgttactggcaatacttttgagttcaggaactgatcaagggtggaaatgatgtggggtgatgagggatgagttcttggatatactgagttggagaagcaatgacagcaagacattcacatggcagtgctcgaaccacacttggccatgtgggattagagtttagaaggtagtggcaataactgaaaaaaaaaaaatgcctgggaggggatgtagggaaagagactccattgatggggccagtttcttgagtttccagttcgtctggctccatttggcttctattctaagccaaactcctgctcatcctaattggaatatatggactttgttttaaaaaaatcactagggagtcatactgagtaaattttatagacacggcaccataattttatttattgacttaaattgagacttccataaatgaataatgcttgaaaattggctctttgtaggttccaaaggaaaatctgaaaattttaaatgtttttcctttctttgtttatgaatctttttaacaatggaaatgttttgtctcctaagagtggcatggagctcaaatatatgactcactggatatgacgaccacctctttaagttgtaacaaatgggaagtgagttaggagagggcccaagagaaacataagctgatcctcagaaaagtgtaagtcctgtggggatacctctaggttggaccaggagtgaggtggagcatcataatgagagacagaaaaagtgaataaatgttagtgactgagcagctgggttcctaaaggaaaaagaaatgccaaaagaaaaaagcagagaagaatcatttaaaaatctctagctttaatttactagattccctcccttcatcaaagtagaccgctgtctttcctgtcaggagttactgagagccctgtacatttcatgatgaaagagaccagccctgggctggtccaacccctcatctactttttttttttgaaacagagtttggctccgtcgcccaggctggagtgcagtggtgtgatctcagctcactgcaacctccgcctcctgggttcaagcagttctcatgcctccgcctcccaagtagctgggattgcagatgtgcaccaccacgcctggctaatttttatatttttagtagagacggggtttcgccatgttggccaggctggtctcgaactcctggcctcaagtgatcctcccacctcggcctcctaaaatgctgggattatagatgtgagccactgcgcccagccttatctacattttgatcaagtttcagctcttgattataagcccacgcctatcaaactcagggatggaggaccagttttgtgagtttcccagaaaacttccttctctgctctggctcttctcttacccttgacttgtccatttttttctaataagtaagaaagaggtgaaactcaaatcagccccctgtgtgtacacagctgtggtcaacagatttggcagtggagaaggttggaactatggccatccaccgggcaaaattgtcagtgaagcaatgttagcctctgttgcccctcgacgtcactctccatccctcttctctggtacctaactcttcccaggtgccttcatcctgctccccgcctttgccaggtgcctgcccttcttcactttacctgcccacactgacaggtgtcattctgagggtagtccatattgaatgttgattttacccagggctttcccacgttgcccagtgtggtagctctttgctagatgatcagatgaattcacccaattcaaatgaactcatactaagatgtgaatgactgatgaccccttcagtgttcccaaaggtattttttcaattaaccctttcaggctgggcatggtggctcacacctgtaatcccagcactttgggaggccgaggtgagtgcttgagcctcaggagttcaagaccagccctggcaacatagtgagacccccatctccacaaaaaataaaataaaaaaattagccaggtgtggtggtgcgtacctatggtcccagctattcaagaggctgaggtgggaggatcacttgagcctgggatgtctgaggctgcagtgagccacaaccgcaccactgcactccagcctgggcaacagagtgagaccctgtctcaaaaacaaaattaaccctttaaaagctaactcaacagattagtggaatattaaagtagcatgagagatacagaagaacagagactaaggaagaagtaactgcaattaaattagggcaccaaagcacctagccacttgcctacatttgccttgttggctgcagggttattggggaacttgggcactcattcagtcctgctttcgagccgaactatgattttaattatcccagaaaacaatcagtaccctaccatcatttcaagaaaataggctcctggaggctaccaggtatgtttcactgtgcaatgttagtttgcaaacatacttattctttcctattaattgtatctcaagataacattgtaaaaatatccctttgtaattaatttttttaatgtataagataacaccccatgtgggtcagtatttggggatgtaacacttctaaagggtagtataaattggtccaagttttctctagggcattttgcaaacaacatttatggaatttctgaaagaaatagccacatatgtatgtaaaaatttagcccaaaggatttattgcagcattgtttgtaatcatgaaaaatcatacacaccaaaatgcccattaagaggaaatttgttatatagataaatagtacatacaacaattgaagtgctattcagccatcatagatggtgttgtggaaaattgtttgatgatatagaatgacgttcatgatatattgtcatgagaaaaatcaagttataaatatttttgtgtgatataatccttatacatacatatatatacatataaacatatatgcatgtatctgtatatatgtaaatatatacacatataaacacatgcatatatctatatatgtaaatatatatacacacatagagaaataatatatactaacatgttaatgtcatttttctctgagtggtgaaattatagatggtttttattttcttcttcttgcttatctgtaatttctcgtttctccaatatgtatgtattattttcatagatagaaatatagaattacttttcttttaagagatctgagcattttccccaaataaataactcagcagctcttgtagtttataaacccagaggtgtctgatctagcttaactcataagaaagaaatggcttaatagatataacgtctgtgctcaaaagcagcacagttaatggaagtttaatttatgcaaacatacacgttaaaaagtattgattaggctgttgaaaataatagtaaattaacatactgccctcttttggtagctatttgtaattcagcttacgttcacttccattaaagatgttaatctcctacaaatgtgtgcataaattaaactaattttatcttattttttaaaataaattttattgtgcacatttgaggtttataacatgatgggatggagtacatatggatagtgaaattgttacagtagtgaggctgataaacattcacatacttttttttagtgacatgagtagctgaaacctacttatttgacaaaaaatccttaatatagtacaattttattgattttagtcctcatgaaactaattctgaatcacctcttttcctcaacagaagatactgataattccagtttgtcaccaccacctggtaagttgtttttttagaactctggggaatttcaggaaaatattattctgtaagttctctatgaaacatggcatgtagtcaggtacaacaaaattgttttcctccaagaagcttaattaggtcattaagcctacacctgaaaaatcaatgcaagcatagaccagaggacagtcatattgatccgtccatattgcgggacaaagccaggcaacaaatcacaggggactaaattgttagttttcattacagtaattacttaagttcagcagttatttttagtattctagttcacaagtctcttgaagagtatcaggaacataaacatgccagatgtttttacatttaagggaggagatgagatgagatgttcacttaaatatacaccctcagtacctccactgaaaggatatttttcactaggattctaagggcccagcactcaccagaatgggaaggcaaatacattagaacccagattggcaagtgcctggaacagaacctgaattcgagactgctagctggaatgggaccttagggataaagtgacccagccctgtccattagttgatgagataatgaagcctggagtggctgaggaacttctctaagatcacacagctccttgctccacatcacacagaggcagcacatggcttctctgactcctacttctgtattcttttgggtacaccatctattccagaacaatcttttatgatggggagtgagtcaactcacattctttctgtagttgtgtgcaaatgagcttctactgttattgattcattatttaaatccaattaatcacaatagctatacttctcatgcactactatgtatctggaagccttcagacatctcctcgttctcctctcagtcttgcagcataggaaatattcgtgttatagatgaggaaactggggcttggggaggataaaacatgctcgtgttcacacattctctggagccagatgacttgagttgtaatttggccaccaccttcctgccttcattcctagctgtgtggttttgggctagttcctttaacctttccatgcctcagtttcctctcctgtaaattagggagaataatagtagctgttgtcgggtagttgtgaagacggaatgagataacatatgtgccaggcacagtgtaaacccttggtaagtggtaactattatttttacgagtttttgagtaatggggcaaagattcaaacccaggactgcaggcctccaaagtccaagctcttttgatctcgccaatttgccccctagttgttaagcttctagggcacaatgaaccactatatttttcttccaatagaatagtccttagcaaactgaatcatggtgatatctgcaaaaccttgtttgcatagaatagggaatgggactctggggggacacactgggtctagtcacagcctggcttctgggtgccctgggggagagcagtgcaaactggaaggtaagagccagtgtagcatcaagggatggatgggcagccatgcccagaggtctcttctttgcacagtgtcaccattcatcaacattcggaagaattaatagtcattccttaaaaactagttgtggccaattattttgttctgccccaagagcaaaaaggattctatatctacactttgaatcttattgctcaggaactgtcttacttctcaagaaatatccttggtaatttaagaaataaataaatgtagtaaatgacaaaatatggaaacaataatgtggacagacagggtgtgtgtgtttcagccaacacaagagcagtctaaagcaggccagccaaagtgccttgacacacccaactttggtccataccagctgaaaatcaggctccatactgcaaaacttattttagttataaaatgttggtgtttgcttttcccatgtttaggtagaggtcaagccattgaatcttttaaatatttaaatatgcaaaatgtgtgtagtagattgacttcttagcttaagtggagtcattccacaggaaatttatcacttgattaattgccttaatagcagccatattttaaaataacttaccaggaaatctggttaggtagtacagtattgagtggtagcaatttttttaatcctaaatttactgtgggaagatttgctaggcatcactgtaacagaatggcaccagcgtgccaatatatttcatgattgtaattcggcaagttatttaaaatgttttctagaatgctctggctgaaaaatttttaaagtagtatttcttgtattttggtctggttcctaatcttatttctataatattccataagtagttagcaagctttgcaatcacgggtctcaggttcactcatcttgggttcttttcctacaattctctgattaaattttatactcactgagcgcttatgggacatgcagatttaactacaacttggtctgctagtgtgttttctacttcttttcgtaattatatctcaaaagttttaattctttaaaatttgacaaataatcgtttcaaaatattgatttaatttttttttctcctgcagctaaattatctgttgtcagttttgccccctcctccaatggtactccaggcaagattttgaaaaaatttaaacctagatttagtccaatttgttaaagttttgttttaattatatctttgtattgtttttctcctcgggacaaaaagaggttgaaacaacaagcctcaatggtaagaatttttctgaagcaagtgaaaattgataacccttaatatgaatataagtataatgaatggtgttgaaggtttccatttctaaattatttctgaatacgtcgagtagtttcaaataacccaaaacaaaacttgccaaccctggagagtgacctaaactttctggttaaatgataacattcttacagtcatggagggaagagagcagtccaccactctaattgttagctaaaaataaaagaaatatcgatcacattttgaattatccattcccttgctgtccaacacaatgccaacaagttttacatgacagattgtttaaatgtgaaaagcacatccagttattcaatatgattcagcatggatttggaggcacagtgtgttcaaagacagcctttttacagatgatttgatcaatttttaaatagtatgaaatgggaaaaaaatggcttccctatcatgctagagaaaagggcaaagaagtgggctttattcaagggaagggggcagagcagtacattctgttccctccaataagtgaacagaatgggtagacagccttccttccatcttattgcgatgaaaccccaacacttttcacaagcccttggttaaaatcaaatctcaccatatggttggtggctaaggagctaaacaatcatagatgcagcttatactgatcaaaactggtttaaattcatatttggcccaatgggaagggacagatgttatcatttttatgtgcagttacttctcacagtgaaaataatatcttcaatttagctttggtgcagtttttggatcccattttgtgtgtgtgtgtgtgtgtgtgtgtgtgtgtgtgtgttttaagtatgatgtaataaatgccttttggttttttcctaaaatttcatccagaatcataaattctagaatgatttggatttaaagaaatgccaatagaatcgattttaaattggattttaaatcaaacaggatccaaatgagattttcttaaaagttagtcgaatataatggtcatttactccaaatttaagctagaattattttaaattgctttataagagtgtaccactggtaaaaatgtattatgcatccacagggctatatattaaaatcagtattaatgttggaaatgtcatatcccttagggacgttcattataatagagaaaaaagggacaaaatattaaacaacatagatgagtttattcaaatctaatggttacgggagtgttgctaagtgtttagacatgtaacttgcatttgaatcaatgaacatttgctccggaattgtctccaggggttggagaatggagtagtgagaggatgggtagcaaaaacatttagtagtgtcagttggcttttgcaaaactaacttctcccagatttggggaaaagggaaatgtttaaggaacctaggaagacacacatgtttgtaaaccatgccagtagttatgctaatttttattattttatttcagatgttactttaagcttactcccttcaaacgaaacaggtaatatcaagtgatttctaaatgtaatagcttcttctgcagcctcttgagtgtcttgcttgtgcagtctactgggttactaaagagttttcttttgcctccttgccctttttcctgtgccttcaaccattgatttatgacccctttgactttgacattgaactataattctgtcaccacactcccaaacttccaaaggatggccatagcactccatttaaaatagcatgtattatttttgtgattataatagtgatacatattagctcataaagatggagaatatagagaaatgcaaagaagaaaatacaaatcatctttaatgttactttcctaagactatgactgttaacaatttggtctatttccattcagtatcatttatacatatatttatatacatatactcttatatcctttgcaaaatagtcataatttacatagatttttgtatcttgcccatttgacttaatattacgttagaagtatattccagtgtcccttactattatgacttgataatattccattttgtaccatatgttgaactttaaagttgtttctatctttttaatagaagttattgcaatgaacattctggtgccaacatctttgcattcatttcttatttctgtaagatacattctaaggattgcagtatgcaaggattgcattctaagggtcagcagtatgaatattgtaagactcttgatactactgcttggttaccttctagaaaggtcgtgcctagcgacattcctgtccgcagtggatgagaatgtctgtcactgtacctttgctgagactgtatcatatcttattaaatctttctctcaacgcttaggttttatttttcattcatgattactagtgaagttaaacatttttaccccagagcactttagttaccaaaaccagaagttcatttcacagttgtattttgtttgctctgaaaaggaaactatcagggcaaacaaaataatatatttaaaagatttttttttttttgagacggagtctctctctgtcatccaggctggagtgcagtggcgccttcttggctcactgcaagctccgcctcccgggttcacgccattctcctgccttagcctcccgagtagctgggactacaggtgcccgccaccacgcctggctaattttttgtatttttagtagagatggggtttcactgtgttagccaggatagtctcgatctcctgaccttgtgatccgcccgcctcagcctcccaaagtgctgggattacaggcgtgagccacggcacccggacctaaaagattcttaatgacaatgtgaaatgctatcagccttcataattaccacccatcattggctcatgggtcacacattgaaacctgacagtttcagaaacctcatttgtgtgtctttgttactgatgagtttctgccaggataacatcatcattcttaagtgtgtttccaatctctgagcttggccttttcttcagaatttgcccatccaccctaggtgacagagcttcggtgaaaatctatgccctgaacacagcctctttccattggccatttttacagcaaagatttctgtacctgcttctccgttacctggggaatgaaccatgggctctgtccccaaaacgtgtttggaagacatttctaaagtttgcttcttcagggcatgttaatatttgcctgtgagtcactcactttgaacagtcttggttctgctgtgggcgtgttatgtgattgtgtataggtggatgatctcgacctctctgagaatagcattctctatcagtacaatggggatagtattatgttaactcctaaagaagatagcgagacacttgattgtataatagcaatactttacatcccatgtgtactgtttcacattaatttttattctgaattacctgtttttacaacctatcacctgaaggtcccgatagtggcttaattctacatatctgaagtgtaagtccacatcatttgtctagcagcagtgtgtggaaagtaaagtagaattacacaggcagtggggtgtgtaatgggtgtgatctaactgcgtaaacatggaactccaactcccagactcaccctgtgccaatgctacatgatccgtggatgcggttcctattcattctgctgctgagatgaccgatagtgtcttaaaggtgtcaacagtgtgactttttttttagcacttcactaaaatgatactcatggcaaattgtttttaaaaaacaagcaatgattattctctaatatttaagttgtttctttgcagaaaaaactaaaatcactatagtaaaaaccttcaatgcatcaggtatgacttattatcaatatcaagactttcctttttataactaaagtaaaattaaacaaatggctggtgtttataatttctttctcttttttccaaacttttcaagataaaatctggtcttaacaaacagatgtgtatgcactgggtacctgaaattgtactaggtgtttggggctatataataatgatcagacacagagcctaccctcaagaatcttctagtctatgggtggagacaaggcaaaaaaatagataactaacatgaacatgcatgcagataaaggcaatgattatacaagtattactgacatggttaagaggcataggagtagagggggatgcaattaatgaagaagttagaggaatgaacctcaaatttttttttcctgagacaagatctcactcagtggcccaggctacagtgcagtgatgcaatcatagctcactgcagcctcaacctccttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcactaactcaaattataattttagtttgtacccaaactagttttctcatagaaaagaatttaaggatttgtaatgtgcaatggaaataaacttgcagttgggcattgcacacataattctgaccaaacaagacctaacaaggagacaaaaatatttcttaatataacaagtttttcccttggcagtttgtttaatacattatcagcatttgctcctcccatgtactatggatttcttatgctttgccaaaaggatgcaattaataaaggaaggctttttagagaagtaaaccttgagttcttttcaaattgaagaagagatacacttctcctctcaccaaaggagaaagtgtttctcaggttaatacgtataaagttttggttctgatgctcattttatctcccagtcatctctgtctcctttgtatgcctgtgtggtctgttgtcctggtcatcactccattttgccctcactaataagtaaattaaaaaatgctttttatttactggctagtatcatccactagattgtatgctccttgagggcaggatctatatctggaaactcccaaagcctgtagaatatggttaatgctcagcaaatatgttttgaattttgtagtttttgcccatgaaacaatattatgacattaatgttatttcatacatacatttgcataaagagctaggattaacattagagtgttcatagactcccctacataggaaaagaaggaggatctatgattaagggccattccatttaaagtctctacttggtttgtgttcatggtgctctgtttatactgaacaggagagggattaattgggaaggggtcaaaaattttagggaggagttaaggatcagatattgacatactaaagattagtaaagaattaagttccgtagctgacaaatgaccaacaaatgaaaactcatttctttagtctttgtggaattcatccatccaattaattccagcttataatatttctggtccacatttgatgcctacgtttatgaattctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctccttaaaaaaaaaaaaaaaaaaatcaccatgctagctaaggagttttagaattttgggagtaaagaaggctttcaattttagggaaaatgcagttttctgcagtatgaagtttccacttggaccactgccttaaaccagtggtttgaaatcttagctgcacattagaatcacctggggagcattaaaaacactgactcccaagactcaccaactaaatgttttgtcattttaaaaacatgtttgacggtctgataggtgagaaatggtagctcagtgttactttaatcaacatttccttactaaggcagagtctgaacattttttcatatatttgggggctgttttgtatctttttgtgaattacatgtacatgtcttttctgtattttttctaattgatatctgatccattatttaagagtactttagccgggcacggtggcttacgcctgtaatcccagcactttgggaggccaaggtgggcggatcacgaggtcaggagatcgagaccatcccggctaacacggtgaaaccccagctctactaaaaatacaaaaaaaaattagccgggcatggtggcgggcgcctgtagtcccagctactcaggaggctgaggcaggagaatggcatgaacctgggaggcggagcttgcagtgagccgaggttgcgccactgctctccagcctgggtgaaagtgcaagactccgtctcaaaaaaaaaagtacttcatatattgtgcatattagctctttatatgcatatctatggtatatgttgcaaatattttctcccagtattttagttgtcttttgactttatcatgttttttgtcatggaaattttgaaacaattttatgtagttaaatacgaaaaagttcatcttttccccagtgatctgagatgtcacctttgtcttatactaaattttgatagacatttgggtctaattctggatgttagatgttaacactgggtgaccaagctgcgtgggaggtatacagagctgtttgtattgtttttatagtatttctgtaaacctaaaattagttccaataaaaagttaaaaaaaaatactgattcccagtcaccaggctcagagattctgatttaattggcctgggatatagcctaggcattaaggcccttctggaccaggcaaggtagctcacgcctgtaatctcagcactttggaaggcccaggtaggagaactgcttgagctcaagagttcaagatcagcctgggtgagatctcatttctactaaaaaattaaaaaaaaacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggaggacaggaatgaaaatgttcactgtggttccccatgagtgacctgcctgctggcattatgagttttgtttgttttttttttttactttttcttttctttcttactttgcagcattttctatattcttctacaatcagataaaaattgtatttggaaaaaaaggacttaaaaaaatctgtgtagcttctcagatgggaagagaaggctaagtgtagcctgtctgccctttgtgggccagatttctgggatatactaatattaaaacgttggaccttgaggaacaggtaaaagtctttggttaaggatttgtagcaggattttctgcaatagaaagtaaagagtaacatgccccattcagcttcacatgccccattaagctggagcattgagccccattttggggatagagtttctggaagcattgggatcggatcagaagagcatccctcttttgacgcagccccactgacccctagtggctgcccctagtggttaagaagaagaaacaggaatagaaaaggggtcaggatgtgaaactgatgtccagttagggctcagtcattaactagctgtgtatccgtgttccagagcagatgcttttttaccttcagcatctcagatcaaatgaagaagtgagttagagctctgtaaaattaggaaatggactggatcaacacttctcaaatatcaccgtgcacatccatcactcaggatcttgttaaaatgcagattctgatccagtaaggcctgggcctgaaagtctgcatttctgacaagctcctcaggtgaagccagtgttgctggttcatggaccccactttgagcaccgagggtctgtatagagactgtagagcagtgctagtggttctcaatcctggctgcatgttgaaatcctctggagcgttttaaaaacattgatgcagctgggcatggtggctcacgcctgtaatctcagcactttgggaggccgaggtgggaggattgcttgaggccaggagttcgcgaccagccagggcaacatagtgagaccctgtctctacaaacagtttttaaaaattagccgggcagggtgatgtacacctgtagtcccagctgcttgggagactgaggtaggaggggtcacttgagcctggggagtggaggctgcagtgagtcatgatcatgtcactgcattccagcctgggtgataaagcaagaccctgtctctgaatgaatgaatgaatgaatttaaaaatacatcgatgggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaataaataataaaaaataaaaaataaaaacaaaaatacatcgatgcctgcctcccaccctcagagactggtgtaggatgtggcctgggcttcccagtttttaaaaactcctgggtggggtggttctaatgtgcagccaagttcgagaaccactgggctagaattagatgcccacccagggtctttctaatatgttggttcttaggtttaactgtacattagaaatacctggggtatttttaaaacatactgatgtgtcaaggtggccttctagggtgctggaaatgctctgctttgatctaggtggtgattatatataaaattcgtcaagctctaaatctaagattagtacactttatgcaggctacaccgcagtaaagaagcacattaaaatgccatgcattaaaatgggcactgcgcccaccgccagaggttccaggtcagctggtttggagtgggagcccaggcatcggtgccgaggtactctgaggggttcagatgtactgctggcattgcccaccactgctctgccgcttccctgtgtgcctcacagtggatggagggctctgactagcataaatgacaggagtagaaggcaacctcttcacagttgagcccagtgaacggggccttctgaaggcccccagataagctgaagaaaatttaatgtatactttgcaaagcacctttaccccaacttggccaggtgggttgctacagtgtacagtttagggaatggagcctgagagatgttgggtaaattgtccacaggagtagtgaaagctggagccctagtgaaggttgtttgttcgtttgtttgtttgtttctgagacagagtttcgctctttcacccagactggagtgcagtggtacaatcttggctcactgcaacctccgctacccgggttcaagtgattcccctgcctcagcctcccgagtagctgggattataggcacccgccaccacgcctggctaatttttgtatttttagtagagacagggtttcgccatgttggccaggctggtcgcaaactcctgaccacaggtgatccactgcttcggtctcccaaagtgttgggattacaggcgtgagccatcgtgcccagccaagtctaggctttttgactcatgatgtttctgactgtctgacaccctttatcctcactgccccgaacctcaggggatgcagggaggcctgtggccaagtgaccagccagactggaccaagcaggcttttctttttatagatgtgacttgctttaggccccttgacctaatattcctccctcttctcaccctagagaagctctaagaacacattcttgttggtgttctaagtctccatctgacactagatcgatcagaggcttccttgagtaaatattccctgggtaataatttgttgctcctcctctagttgttcctccctagatctctcaagactgatggatcttgtgccagagagtaggtgaggacttctccacctttgatgcccatgaaaatcaccagagagtttagaaaatacatatgccccatcccaagaccagctgaatcaaacacagaggagtgggccatagaaatctatatacacatatgttttaaaaagtgttctgggccaggcacagtggctcacgcctgtagtcccagcactttgggaggctgaggcgggcagatcatcggaggtcaggagttcgagaccagcctggccaacatagcaaaaccccatctctactaaaaatacaaaaagtagccgggcatggtggcaggtgcctgtagtcccagctactcaggaggctgaggcaagagaatcacttgaacccaggaggcggaggttgcagtgacccaaaatcacgccactgcaccccagcctgggtgacgagtgagactctgtctcaaaaaaaaatgttctgggtagttctcatgcacagccaaggttgagaaccactgagctaaaggaaccttgaagacacagctgctgtagaccacctcttttgccccagcttgattcattgttttcattcaaccaacatttcttggtcagttaccatgggtcagctaccactatgccaggctatagcagtgtaaagttgattaagacagattcctagtatatgaaaaccagttgggtcacgagacatttcgcagttcccctcacccgggagcacagagaagattccctcaattgagtgaccatgagacacagagccacagagcagcagtgaactggggagtcacagaagagcatctctccttgcccattcctctcccaggaagtaggtggtagaagtgggcaggggctgggggatagtggcaggtgcacagagggtgtgaaatggcagaggctggaagtgtcatgtccctgatgtaactacgtcaacttgacggtgtcagatgattgccagaggggaaagacttgccccctctgtagctcattcgtgtctcacatgtatctctctgatttgttcctttagtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacaggtaaatgtcacttgaacagcggccaatctgccaatcaagacatctatgataagaccatgttgagcctttctttgtatgatgttcgcttgatttctagagctttcctttcgggattctaacgttctaatgacttacatggttgcataagagtcattgtgttgaggtggcatatctaatttaatcaatatctaatttaatcattcctctcttctgaaaccattaagtttattctactttttagctcccaggtatcggtatctttcatgcagttgtcactttgcttcttggctgtggctgagttccattgttttgaccaagataatggagaaatagctctaaagggcaagcacagatctcatttgatggagttggagattttctaggtttctttctcctacaaaagttggttggaacactgttttcaacaccctgaagagtaaacttttgatctattaaacatagcagctcagcttagacagaagacaaaagaaaaaattggcaggtctgaaaatcagtcagtcacagagtgacagagctgggactgagccaaggtagtggtaggaggggagaaacactgtgaagacccaggcttgggtccgcacgggccctcgcagacagtgtaatctggaacaagctccttctgcctccgcctgttctatgcgaggatcaaaatcatcacactaactgcatgaggctgagaatgaaggtgtacgtgagaatgctgtggaaaccgccaaggcctccagggtccaaagtgggcttagtggtacagagataaaggcaagagggaaagaagctgagagaaatctggatacactgaagtttcagttccatgagtaagaggcaggtcttcctctagaatttggaggatgggggaggcaaagccaagtttttggtgacattagattgattttggtacccacctcctccaccctggtgccagcatcaccaggagatgaggagcttctgccaaatgacttcatatttcttcaaatttgcactgctctctcttcagtaaagttttttaaattgtttctttttttttttttttttttggtagctttggggtcttgctatgttgcctaggctggttttaaactcctgggctcaagtgatcctcccacctcaacctcccaaagcgttgggattataggtgtgaaccattgtgcccagccaataattttttataaatgtaaatattttcagccaaattagaaaagcattggggctgtagtcaaaggaaggtccaatggctgatgaagaatacagtaaaattgaagttcattagcctgggcctaagatgcccaccttcccaaagctaattcccagtgatccctagactcagcctaacaggctacacaaaacactatcaaggtggcctctggtgcctatgtattcctggggcaacaagaagcaaagtgacatattcataaaagatacagattgaggtgttacccaggagctaaaaattagaataaacgtaatggttccagaagacaggaatgattaaataagatatgctactgtaacacaatgactattatgcgaccatgtaagtcattagaacagaaacagaaatatacagaaacttgggggcattttcaagtcttgatgtgaggtgaaaatagcccaacaacaaatagtttgcacaccatgtttataacagtgtaaatacacatgcataaagatttgacgggaataggcaaaataataggatgttaagtggtgaaattaagagttgtctgttgttaaagacaggtttgtatcattgtttccctattaaaaatcagacttacaggtgatagtccagctttcataatattcttttttgttttgagagagagagagagtctcactctgtcacccaggctggagtgcagtggcgcaatttcggctcaccgcaacctctgcctcctgggttcaagcgattcttgtgcctcagcctcccgagtaactgggactacaggcacatgccaccacacgtggctaattttttaaatatttttagtagagacagggttcccccatgttggccaggctggtctagaactcctgacctcaggtgatccacctgcctcagagcctcccaaagtgctgggattacaggcgcgagccaccgtgcccagcccataatattctctttttcacaaaagagcttccagcaatccacataaaatcctgtacacatgatacaaattaaatacaagtatacttgtgcttatatgagtatatactaaatacactgatgtgctttatattttttagatttattgaagtaaaatttgcatacagtaaaatgtatccaattttatggataaatcaaatttttgcagttctgtgcagctagaaacacccacagtcacgtaaccaccatcataatcaagatacataagtttcccactactcccaaagttcccttgtgtcccttcgaagtcaaaacctaatcccctcacccccagcccctggccaccactgatctgtttccatacaggtttttggatatttctagaatatcatatgaagagactcacttagtatgtggccttctgagtttggcttctttcacttagcataatgtattggaaaactggagatccacccatgccattgtgtgtatttagagttaattcctttttattgctgaataatatttcactgtatggaggtaccatagtttgttgatccattctccagttcatggacattcgggttgtttctagtttgggactattatgaaaaaggccactataaacattcatgaacaagtcttcctaagacatatgtttgtatttatctggggcaaatacccaggagtgagtttgccatatcacagggtctatgtacgtttatctttattagtgggttttccattgtgtgttcataacacgatttggctctttgatatagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaaggtacgacttcgcaaactgaagtggtggtaagaggggaccctccaaagataaagatgctgctcacatgattaatatcaccaagtcttttactcccaagtaccaggtacatcatggtttctcaggttgctactctatattctgcttagaatgaggagacagatgggactgccaaatctacactaccaaccttgaggccagacattgtggctcatgcctataatcccaccactctgggaggctgaggtgggcggatcgcttgaggtcaggggtttgagactagcctggctaacatggtgaaaccccgtctctactaaaaatacaaagattagccaggcatggtgatgcgtgcctgtagtcccagctactcaggaggctgaggcaggagaatcacttgaacccaggaggtggaggttgcagtgagccaagatggcaccactgtactccagcctgggaggcagagtgagactctgtctcaaaaaaaaaaaaaaacaaaaacaaaaacaaggctgggcgcgatggctcacgcctgtaatcccaacattttgggaggccgaggcgtgtggatcacgaggtcaggagatcgagaccatcctggccaacatggtgaaaccccgtctctactaaaatacaaaaaattagctgggtgtggtggtgtgcatctgtagtcccagctacttgagaggctgaggtagtagaattgcttgaacccaggaggcagaggttgcagtgagccgagatcacgccactgcaccccagcctggcaacagagcgagactccgtctcaaaataaataaataaataaataataaactgccaacctttctttacagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtacatcataattgatggcagaaaaaaacattctcttgtgtgtgattgtagtccccattgtatttcatgattgaggcaattactgcttatagtcaggggtgatattcaaaatatttggcatctagaacagtgaggcaccatagaatcaagccgggtgccatggctcacacctgtaatcccagcactttgggaggccaaggcaagtggatcactggaggtcaggagttcaagaccagcctggacaacatggtgaaaccccatctctactaaaaatacaaaaattagccgggcgtggtggcatccacttgtaatcccaactactcaggaggctgaggcaggagaattgcttgaactcgggaggcagaggttgcagtgagccaagattgcaccactgcactccagcctgagcgacagagtaatattccgtctcaaaaaaaaaaaaaaagacgttggtcttggctggtacaggatgtcagaggtcccccttacaccttgcgttaaccctttagcagctgaattttggaatgtggcatgggtggtatccagcagagggttctaggcaattgggagagtaggcaggggtgtcagctacttaacatcacatttcgatattataacaagtgttagaactgcactgctgtatatagtggtgctgagtatcattcctgtttctagtgttttctgtccacctatttagagggattgggggctacaaacacccaaggaaaccaagtctcgctttttaattttcatagtcttccctttacaagtgtactgcacatggttctatgaggacttgactctaactggtcactaacttggtgtgtctgctgctacagtctccctggggtctgcagtcatcttgcacttttcaactatttctttgcatccttaaaatgtttcctttccttcttggaggcctcctctccttattacacttccttttttttctttttttttgagatggagtctcgctctgtcacccagggttgagtgcattggtgcgatcttggctcactgcagcctccgcctcccgggttcaagatactcccctgcctcagtctcccaggtagctaggattacaggcgcctgccaccacacccggctaatttttgtatttttagtagagacagggctgcgccatgttggccaggctggtcttaaactcctgacctcaggtgatcctcccgactcggcctcccaaagtgttgggattacaggtgtgagccgccgtgcccagcctatacttcctttctttaatttagtagcaaccagaggaatagaagtagaagctattttgcatagagatgccgcaggtcaggtccttacagaaccctgcgttttaattattaggctggtgcaaaagtaattgtggtttttatctttttttaaaaaaaaaatggcacatactgcaattacttttgcaccaacttaatagatgtgttttccatctcattatactagctccagacatttattcttatcttccacttgattttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgccaagcactatcctaagcagttacaaatgttaactctaatcctctcaacaaccctgagaggaaggaactattattatcccattttacagatgaagccatggaggcgcagagagacgttaagtgacttgcttggggacacacggcttaaatggcttaatgctatgttctctttaaagattcacaaaatcctgttgtgtcaatctgtgcgctttagctcagtatttagagcattgtattgtagaacaagctctgtttctctgattgtgatcccttgggaaagtcactttcctccttgtccctcgatttctgacctatattgtaagataaacaatgtggactgaatattccttagtgttccttctagctctaaaactctgacaatatctcatttacccttgccatcttgatgtgccaggatccttccctggagaacctctctctgatcagctacgtcatatcatcgagtgttgcaaacctgaccgtcaggaacttgacaagaaacgtgacagtcacattaaagcacatcaacccgagccaggtggggagaggccagtgccgtctgttcattgaccaggaacaccttgtacaaactatgcttgtaaggcatggccggcaaaaggcagatcaggcagaaagaaccttcagctcagctggagtagtttgcaggactagaatcacatctctccattggattttaacacacttaataattgaccagggcaggtgcagtggttcatgctgtcatcccagcactttgagaggctgaggcgggcagattgtctgagctcaggagtttgagaccagcctgggcaacatggcaaaaccccatctttgcaaaagatacaaaaattagctgggcgtggtggcaggctcctgtaattccagctacttggagggctgaggcgggaggatcacgagcccgggagctcaaggctgcagtgagctatgttggggccactgcattccagcttgggtgacaaagtgagaccctgtctcaaaaaaaaaaaaaaaaaaaaaaattgaccacctaatttccaggaagaattggtgcaaaagcaagctcttaacaactgtgaaatatcagatatcagtgtgtgtggatctgtggctgcaggtctgattctcagctcagttcacactaagcatcatctacgacctcactactcacagtgtggtccacagacccacagcatcagcatcacctgggagtttgctagaaatgcagagtctcaggccctaacccagacccactgagtcagaatgtgcattttcacaaggccccaaagtgattcctatgcacgattgatgagcttaagaagtgctggtctatttagggcttacttgcttctagggaccatataaaataagaactctctaaaaattaagcctaagattctgaaatttaaaaaaaaccacagttttttttcttttcaaatacctttcagttttgctttttttttttttagttcagtaaattaattatgtgtgatttatctttctaccacaggatgagttaacagtgagatgtgtattttgggacttgggcagaaatggtaagttccagtcataaccttttcaaactcttgagtgggttaattggggagggtgtgaagtcactggtgctgtggccttgctgatgggacagatgttcttcccaatgccaacaggtggcagaggaggctggtcagacaatggctgctctgtcaaagacaggagattgaatgaaaccatctgtacctgtagccatctaacaagcttcggcgttctgctggtaatatgcctgtgccacgtggccttaaattctgagtctgaggggtagctgggcatcacactacaatgtctaatctgatggatggataaccgtgacagatcagcagatatgatattgtggctgatttatacaccaatgagattgctctttgctgggcatggtggctcacgcctgtaatcccagcactttgggaggccaaggtgggtggatcacttgaggtcaggagttcgagaccagcctggccaacatggcgaaaccccgtctctactaaaaatacaaaattagctgggtgtggtggtgcgtacctgtagtcccagctactcaggaggctgaggcaggataatcgcttgatcctgggaggcagaggttgcagtaagccgaaatcacaccattgtactccagtctgggcaacagagagagacgccatctcaaaaaaaaaaaaaaaaagagagagagattcctcttctaataagcaaatgcacctgaaggaaaatacctgaacatgaaagacaagtattttttcacattctctttttacatttaagtttttctcttttaaataattaagagaactaaggaattcagattaggatgagtaataaaaattgtttagtttgcaatgcactttaagatttttacaaaacactttgacataaatgctcttatttaatcatcccaacagtcctgcaagataggtagaatggggagttgctattgtcattttattaaaatcagaattaagactctcttgttagatagttgcccacagtcatagaactaagaaatgtaagaggcaggagctaaattgcagtctttaggctcctagtccagttcctttccattgcactataatgcagtgatcaagtatgtgggctttggagtgtgccagacctgaatttgaatcttggcttctccactttctatctgtgtgtccttgagcaagttacttaacctctctgtgtctgtctctgtttccttatctttacctgatagtaataattgtgcctacctcataggtttgttgaatagactatgaatggatccctagaatacttgatacatcataagtcttgtatttatttaaaaatatttgattattaaaagcaatatttcattttccaggacctatctaggacatctgtgctgcctgctcaaatgatggctctgacgttcattacatatattggttgtgggctttcatcaatttttctgtcagtgactcttgtaacctacatagcttttgagtgagtatccacaaccggaaatttggatttaggactcagcactcacctccattgccaacatttattaactaagccctttcctcggcctgccttaccctgtacacccagctagtggagcatccatgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaatagatattcagtgagtgtagctctgcagcaagaatgccattctaaaaaacagcctttccttcttggcttaccagacaggtccctttggttgctttttgggggtaattccaacaaattctaatggaaaagaaggacatgggcatttttattgcattaacgaatcgaaacaatatgtaggttcttggatttagattttggacactgatcaggaaatgtaaaaatttattttcagtgccaaagttagggtctagctgtgactacggatcttctagtgagcctttggaaatattattagtgagactaaataaccagaaggccagccattactcagaatgatttcatcggatctaattttgcatgcataaacatgaacatgtcatcaattagctggcttctcctatgctattacatttagctgtagtttaaactcttctttccatgatctcattttacctaataacatacaataatatgggaatcttggttaaattttgaagatctgaatatagcagactccatgagaagcagcaccaatgcttccgaaagtagtctgggagaaatagggcgagtgcttagtagagtctactacaaactatttaaaagtatgcgtcaacagtcagcatgtaaaaggtcccacagaaatacagacacaaattctccttatggttatcacagatgattctgtttagatttttcctttgttgttgttggttttaagctcccccccaccccatatacacatatactcaaacagaggaaatttatgcatatagacatttaccaaagaataaaaataaattgcttaaaactcaaagagcctgacagatatgcttacataagggttggtgctaggtgtggtaactcatgcctgtaatcccaacactttgggaagccagggcagcaggattgcttgagcccaggagtttgaggccagcctaggcaacatggcgaaaccgtgtctctacaaaaaaaataagggtgtggtagagagcgcctgtagtcccagccactcaggagactgaggtgggaagatcgcttgagcccaggaggcagaggttgcagtgacctgagatcacgctactgcactccagcctgggtgacagagccagaccttatcttaaaccaaaaaaaagttggagggttggcagagtagaatgctcattcttgttctcatcctttccttttagaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggtatgtataagcttgcctgcatgttgcctggactttctctgccttttctctagtgttttgatttttgagcaggtggaaacgatgaagcagatcacattcagcaagtttctaaaacagctttatactcttacatgtgcactgcccgaagagcaactttgtcaagtctccttctaggacacctgtttatttctttggatttgttatgaatatggaattcctcaaggttgaaccatgaatcctctttgtatctccaggaactagaatttggggctggcacagaaggtgctcaatatattgaaaacattagcttggggtggtaatatattgaaaacattagcttggtggtaaagagcccaaactctcagtccctgagctcccagccagcctcattctactttgtacctcccagatatcagacacgtatgacagtatgctaagaagggcagagtgagagaatgtacatataaaacccattgtaacttcactgccacgtgggcatgacatttcagattgtgcagcctattggtggcaggtcgcaaggccttaggctccccaaatatgttgaagatttcttcattcaatttcccacccaatgcaggagcctcttcaaccctcaactccacctgacttatccttgactaaagataatctaacttctgcttgaatacttctattactggggagttcatgaccttacaaggcagccaataaccattttataaagctctacagttctgattttccattaagttcagttggctccctggtggcacttaccagtggttttgctcaggcagaaaacagtaagttgatacctcttctgccagagagtcctttagataatctacaagtaatatataacagtgtgtataatcccctgtttttcacacaagtgaccccatgcaagataagccagtgaggtgagccaggcagtcatcccaaatgtaggtgaagaaactggctccaagtgatgatgtgatatccccccaattcacaaagctagaaaacagcaagcctggctctccgtctccttatatgcagccttctgccatccccccaaccagactgcctctattttcaggctaaatattcctacacatcaagattgaaagcacaccaccacccttgccaccctgccttctatcttatgtcactatgtctttgtgaagaacaacagaacaacaccctttccctgtttgtcccagaaacataagtcaacgctccagatactgggcacggattctgtcttctttagagaaggctgaaagtcagattcctttcttaagtatgaggcccccacccccaatgttttatttttaacaaagtgtctcacttagaaaattatcatatgtcagggtcaccagaaggtacaagcgcaaaggcattaaatgaactattagatttgattttaccaggcactgcaactggtctgtgacaaggaattgtttgttctttaccagagccttgagataggacgtctgctggtcagtgtgcagagtgtggggcggtggcatggggctggcgggtgatggtgtgcagtggtgaataggattctttccccaccaaaagccattttaaacttgggggacccttctcatggtaccttctctgaagggaagtgtccgtgggctctcaacagagccagcatagtagcagtcaccaccccctggatcagccaggacagaaccctccatccttcactgggtctcaaagtcttcaaattgaggacttttggtttcataatgaaagatttgccaggagttgctgactcttaaatatacattccagacatgtataagttaaaggcacaacgctgggtgcagtggctcatgcctgtaatcccagcactttgggaggccgaggtgggcggatcacctgaggtcaggagttcgagaccagcctagccaacatggtgaaaccccgtctctactaaaaatacaaaaattagccaggtgtggtggtgcacacctgtaatcccagctacttgggaggctgaggcacaagaatcgcttgaacccgggaggcggaggcggaggttgcagtgagccgagattgtgccactgcactctagcctgggtgacagaggggggccgggtggggggtggggagttaaaggcaacactggcagctgtaacagattcaccttgaaatctcagtagaagatcatttctcactcacctacagtctagttagcaggggcagaggagtccctggtcttgcagttattcagggatccaagctattgaagactctgcctcaaggttgccctaagtttgcaggcaaaaagaaagtagaggatctcacaggaggtttctatggggcaggcctggaagtggagcaaatcacttgtgcccgtatcccatgggcccaaagtgagccatgtggccacacacacccagctgcctgggaggctgggagcatccagtcatgtgccaaagaggaaaagaaaccagcctggtgaacagctagccagtctctgctacaagatgtaaataggatgtgatctctagtcttgtcacccactttggttattagaactaggtgtgaccagccgggtgcggtggctcacgcctgcaatcccagcactttgggagaccgaggcgggcagatcacgaggtcaggagatcgagaccatcctggctaacatggtgaaaccccgtctctacgaaaaatacaaaacaaaaattagccaggcatggtggcacgcgcctgtaatcccagctactagggaggctgaggcaggagaatcacttgaacccaggaggcggaggttgcagtgagccgagatcgcaccactgcactccagcctgggtgacagagcaagaatccgtctcaaaaaaaaaaaaaaaaaaaattaggtgtgaccaatgtttcccatcttccaggggtaccagctgtggttgtgaccatcatcctgactatatccccagataactatgggcttggatcctatgggaaattccccaatggttcaccggatgacttgtgagtacaaagccccctaagggaatgctaagtgaactggaaaacggaatgctcctagaaaacggaggatctaatcagcatattgactcctgctatcatcctaataaaacccagcaatacttcacagcagccttcacagtcatatgtaatgagagaagctagctggaaatgccatgctactcttcaagtgatgaattaggagctattctgaaaagaaaaatgaattaggaagaactattttgaaaatattttcattagcctctgataaaatgacattccagttatattaataaagactcatagaacagagttgctaggatttacaggggcaaaatcctgaatgtttaaaaaaaggtctatttttaaaatactttaaatcaccaagtgtcctcaaataaactcttagattattttccctagagctataaatggttgtagagaatagcagttttatcattttttttctcttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagagatgttgggggtttggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaaaaaaaaaaaaaaaaaaaagtactatctgtgaaaccccatgaggtatgcttgtatatgcaaagtagcttatttagtggcttatgatattttcattgaaaaacatatttattattgagagggagtgctttgagatccttggaggaaaggtgcttactaaattcaagaaatggtgtttttttctccttattcatagttgtctccttggagagaccatattgaggggaacctgccaggaacactttttgaaaaagtcaattattcttccttcacttggtttcttttaaaaaaaaaaacttttgtattcaagtagaacatgcagactgtaagcacacataccatgactgtgcctgtgggagctcaccactctcccctcctaggtcagcgatttggagacaatgagaaatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgctgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctgtttctctcctaatgcaaccaatggtcgacttccagggtgacaaatgaatgaagctgtgtaatattcagacatgggtcttgacggtgggcacatataccctactagaagcaaaactgttttgtttgtttgttttttgagatggagtctcgctctgtcacccaggctggagtgcagtggagcgatctcggctcactgcaacctccgcctcccgggttcaagtgatcctcccacttcaccctcctaaagtgctgagattacaggcgtgagccaccaccacgcctggcccctggtatcttaaaatgaaggttttaaagtgaatagattgggggtttttaagtagaaagcagagaacccagaattcatccattcactcagcaaatatttattggcaaaagccttggggagtggcagccatggggctggctggggagccctggcctgccttgactgggcacctgagtgggtgagaggtggagtcccagggccccttcaggtcttcagcttgctctccatgccagcacctggggcaggtcaggaggaggcaggcaggtaggtgagtgcattgctgtactgcctgggtttgagggggagagagagatccaagcaaaggacatggcagtgggctggagaggaggagagtgggaagggaaagatgtgtggaggagatggcatttgacagagcttggaaacggattctaaatagggagggagggagaggcaggagcctaagtccaagctgggatcctgggtggatggcttgtaattccaagatacggaaggccaaggacaggatgtgggaggagacagtgaatttaattgtggaaatgcaaagttatgattccttttatcatataaatattcttaatcttacaaagattttctaaaggcattcattccccgatgccttttgacagcaagctttcctaggactctgaactttttattcaatttgcaaaatttcatgttgcccacagctgccaaaataattattaatatcttttgtgcaaagtgagcttatgacattcagctattagcttggaattcattgtgggttttttttccctccttaggatttttcatattcatcttttactgtgtggccaaagaaaatgtcaggaagcaatggaggcggtatctttgttgtggaaagttacggctggctgaaaattctggtaaagatttacctcactttttctcttcctcttaaatctcaaggaaaagattgtataaattaagatccaaagcaaatccaatctagaaatcagtgaattccagcaaatctggaatttgctcaacagaaaatattgatcgtgaacattagggagaaaaaaaaatctagtgaattaaaaaataattatttctatctgggaattttttgagcaataaaattgatgggctggctgcctcttcaatgaagcaacagtaaaatttttagaattgattttctattgagattatgcttttcatttcccaaagtaatttttaatatttaccttggtaatttttaaaatctcaactcaatcctttctccacaggtcctggttgtcagttgctttatttgttagtaagccagactttgtgtataagctttagcatacatttggttgtaacatacatttgtttattttgaagtgattttcacatatacccggttgggtagtagagcaaatagctcattttttttttttaagaaaatgagaaaaatgaagtactgtttgaaaagctacattccttttgcatgaataccacctttgcagtatctgggcgacacgggagtctgtattcagaaaatggcagtacacatagttcaatcattttcatggagtgaagaacaattagtcattacaacacagactatttgtgttcttgttaagacagtgtgaggctctgaatcactacctaattctatggatatttatagacataatcaaattagcttggcctttagttctaggagaatataggttacttttaaccccacagtcatttgaaggacaaatgtaaataatccaaatgaaaatacatgttatcacaccaactggtggaaggtgacttctccataagatcctgaagtgagaaatcagttgcttaggacttgttacactgtgatctgtctcttgcgtttgagcttcaacatactgccctgtttttctgtaatgcttattctgctgtagactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggtatgtatgtctcaatatagtatttctcaagctagtgtttattttttaaaatagttttatcctttattggcattttggctaagcaaagtgagtaactattaatacatatatgactagtggatcaaaatgtggttcccttacagaagagaaagtttactaatccaaattgatttattatagagcaaatactggaacaacgattttttaagatttggtttttcatagtgggaattgatgatgacctaaaaattttaacattttaaatcctcacttaactattgtccaaagacttcagtattgtgctatttctgtgagagcagtacctaaaatagctgataagactatagcaatttttattacatctatcataatatacatgttcaacattttttttttttgagatggagtctcactcttgttgcccaggctggagtgcaatggtgcaatctcagctcactgcaacctccacctcctgggttccagcaattctgcctcagcctcccgagtagctggaattacaggtgacctacaggtgaccgccacgatgcccagctaatttttgtatttttagtagagacaggtttcaccatgttggccaggctagtctcgagctcctgaccacaagtgatttgcccacctcggcctcccaaagtgctgggattacaggtgtgagccaccgcgcccagccaacacttttaaaccttcctattttttgcttttcatgtttgttaattctttcccacaatgtggctgtcttgtgacagcacccaaatccccatgaatatgtcaaaatactggaagatgacttgtgaccagtattggtgaccatatatgtgaccaatatctgaacagattattgctgccatgcctcctttactcattaattctgacatttctagctaaaacttctgttacattttctttctttcataagaccaggctgttcattactcataaaagcttaccttatctatttttaccttctcttgcttcttaatatatcttttgcattcttataaaaacataagctctgctggtatagtttctccttccatggagaatttgcctgtattcattgttttaggatgttagttcttttcatgactaactcaaataaatttgtgagaaggttcatacatctaccagttttcccgtttcctgaagatgggcagtcctgctggtgtgtctagacttttttttttttttttctttttttttatgacaaggtctcctattgcccaggctggagttcagtggtatgatcacggttcactgcagcctcgacctcccaggctcaagtgatcctcccacctcagccacccgagtagctgggactgtaggagcatgccaccatggctggctaatttttttttttttttaagatgcagtcttgctgtgttgtccaggttggtctcaaactcctgggctcaagtgatcctcccgcctcagcctcccaaagtgctgggattacaggtgtgagccactgtgcccggcctgtctaggcttttaaaataccataggatgcctcaaaatcaaggtttctcaacttcaagcacaattgacattttggggctggataattcttttttgtggaattgcaggacatttagcaggatccctggactctatcaactagagccagtagcaccctgcccccagttatgacaacccaaaatgtccccagacactgccaactgtcccaggggagcggggagaagaagggagcaagattgcccccagttgagaatcactgctgtaaaagatgagaaataactgttgtatagccttagctctttactgtcgataccagaaagcaagctctgggctctacaccaaatagctctatcaggaatgattcaatgtaggtaaacagaggcgaggcagcggggagcacagctggttagtacgttagtgtgagaaagcaaattgaaaggagagacatcaaaggagcgagcagggtcatctggggctctgaatccataaaccagatttgtccatattctcgaaagagctcagagatgaagcctcacctgcctagctctatcaacatgttgtcatcctttgggaaatcagatttcatggaaacagcacattttaccacagttgtttaacacagctgatttgacacagctacttttgatgcttgacggtgaggatgggggtacattttaaggctgccaaaatggctcagtgtttaatatcacataatatgcatgtcagataaccattcctgactcctcagtccttgccccagcatctgggatagatgaggaatggaattggcaatttcaaaaaagaaagctagggctgggcgcagtggctcacacctgtaatcccagcactttgggaggctaagttaggaggatcacctgaggtcaggagttcaagaccagcctggccaacatggaaaaactccatctctaataaaaaatgtgaaaatcaaccagacgtggtggcacacacctgtagtcccagctactcaggaagctgaggcaggagaatcgcttgaacccaggagacagaagttgcagtgagcctagatctcaccactgcactccagcatgggcgacagaacgagactccgtctcaacaacaacaaaaaaagctagaagtttaatgatttattatgccagaccaaattgttcttgcaccaaaatgtcctcaagccgaaatgcctaaatccaaacagctgcctcagacagtcacatgccctatttgatctgtgtcacagatggagctacgttaaccatattcatcacctagtttgcatgaatattacacagttcagttctgagctgccttagagggtggggtaccagcagccatctcatttggtacccaggaccacaaggatcacagtttggaagcaacatcacacgtcaactccattacttctgagctgtgtgaccttggggagagcacttaatttctgaaaccttcgtttcctcatctgcaaaatggggataacagtagtacccaccctgcagggctctaaatgagataataaagtgtcccagtactgttatgatcattgttatcataatcatgtcatgaactatcaaatgggcttattattcagctttgtgtatagtctcccaatggtctaatgatcagaaggatggtgccaagtaactagaggaggccagcacctgtgctcccctataactcagggcctgcttggggtggggaaggcccacgtccaaaccaacagttacccttgagtgcccagctgctccctggcctggactctgaagttggaattggtagtttcctcttgggaatttgtcctgtcctgatttagtcagaggagctggtttaatctacaagagagatgatttcttcttgccatgactgttgtagctggttgctctggtttctctggtacaaagtttcattttataggaacctagggaaccaagaacttcctaagggtacatatggggatctctgttaacattaaccttttgggagaccaaagtattaccttagcttatattatacatatgctgctacttgaagtcaaaacatatccaaccagagttaggaagtgggccttttattaatatattaccttgcttcagattttgactgtttcattaaaaaccaaacaaaaaaaaaactgccatagagaactggtttctgaagcaatctccactttggtatgcttactttgagtggccttagggaagtaatgaaaaataaataaaatatgaacatatatcacaaatgtttttaaaaacatattttacaaatacatctttaagaataaagcaatgtctaagtttgtttgctttttaatgctttctgtggatacttcatgccacccgctttgtgtttccttatacaggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctt

SEQ ID NO: 3175 - DNA, 133328 bp, human; identical to SEQ ID NO: 3174

SEQ ID NO: 3176 - DNA, 133149 bp, human
agccccgaggacgcgagcggcaggtaagcgctcggcgccaggacgggtctggccccttggggtcctgagacccagactcgcacagccggccacgggcgctggaggctcgggcgcagcgtctagccccggagggcggcgggccagcgggccggcgggacgaacgcgccttccgcccggctgctgttcctagccggggcccgggaacatcctgaaaggcggaggcgtagctcccagccccggggctagttccccgactgggggagcccgcgcgccgtgggaaaggaggctccaaggggagacgcgcgtctccaaaaccttcggacggagccgtactttccccaacccgcgggaaactgagccacgagcctgactcgcgcgggtggtgtgctagacgccaactcccgggagcccggctccgcgcgcctggtcgggctgcggcggtgctggcggagcgcgaacgcgcccgggccccggacggcttggggcggcaccactcggcgcggccccgaacaggtggccccgggcaccgagggacggagcggcggcccggagccagggggtgagcacgccggggaaggagggggctcgtggtctcggagtgagcgcatttcggcagggactcgagtttcgaggctccgaaacccgataaaaagtgagggggaagaagagagctgacctcccgagagccagacgaagcaggggacaggttttccgtggctgcttcgacagtgacagtctgtactgtgcacgataatcccccagggatcccgttaaaatgagattctgatcccgcaggtctggggtgggggccgagcgtctgcatttctaagaagctcccagtggctgctgatgctgttccatggaccacactttatccggcaggccctacggaagtactttttgtccagcaggctgaaaaccttaggaaaagtgggagattgggagacgaggtcctaagactttacagtatgtatagctttaatacctctttgccacctctacccccaaacgcacgcaaaaacacttgctactataaaggccaagggaaactttcccttcgccccctgaaggttcgcttgaaaaattaactgacaaagacagattgattggagaaaaggcatgcaaatgtattaatgtgtccacggggagagaacaatagagtgattacccccagccccccaatggggtacagaagcatgtagattatcttgaggttacagaaagaaaggggtctcaacgcatggccccaaacaggttatggtggtaaaagaggttgtgagagggggagaagaggaggcttggccagcaaaaatggtctggagatgtcaatgaaacctcacaggtggcagccctcagagagaataaacagtaaatgtttctttcagacctttaaaggggtcagatcctcagttaatttctcttagatctggacaagggaggacctcgataaagcctggctacatccgtgcagattctctacaaatgcaaatcttccgcaccaaggacagctttgcattagctctactggctggctttctaaatacgtcaatatttagaaatatgtcaactatttcaaaatatgtcaaagaaatatattttggggtaaaatgatttgatttccttcactactcatttaatagcgaaatattttacttttcttaccaactttctagccaaatacatgatctgatagcagggctggcttcatggacatgcatcctgcacttggtttaatgctgaaattcttaatttttgaacaaggggcctctccttttcattttgcactgggtcccacaaattatgtagctgatcctaatagtcaccatacgtggaaagagaacccattttttgatcagggtttgagatggtgggtgatggagagtagaggtttattaagggaagactagctagatgttgcagttatctccaatctttctcaactcctctttggctatctgaagagataagtctaagagcatacccaggcatgcatggtgtgacaaaatttattactttattaatatcaacagttaacagtttattaggagcttaattattgatagacaatacaattaagtttgatattgaaataattttgtaagtttattgacaagttgtgtgttattttcaaaggattggggagtctctatttagcatctcataaaattttgcttagttaagatctaagatgagctggacattgcttggtttggcagctttcacagctcaaatgcaaagctggaaaacaaaaagtggccaaattttgtagcttttcaggagtattcttttacagggcctcagcgtgatgccagcccggatcggattcccttctgcttttatcactcccacatctctgcaaggtgactttcattaaaagggggatagagcatatttagctactgaaaaacactgaagaaaggcagggccagcatcagtattttgtctgtgaagaaatcttgcccaaaaaacacagattccaggtgtgtgtatttttctagaaaaaagaaatgttggaaatacagaaaagaaaaagattgtactctaactatggatatgattttgttcagcagagggagaaaaagtcagataagtggcatttcattggcgggtttggcagggaaaggaaagctgctgtgtttttggtaccatgaacagccttccagaaatggcaaagtgagtttgctcaggtgcaaggaagagccagcaaagaagctgattttccatggctgatgtgatcattgtggggactcagagcaggacatcacgacatatgttcttggtgctttgacggctcagatgaaactgaaaaacacatttttccacttttctgcctgagcgtgccaagtcgctttcaaatacacgatccaaactgggaagagtgctattaaattaacaaaaggagggagagggaggtgtttctgtgatgtccatgattcaaaagatagaaaggagggattctgactttagttaaaacctgggagctagtttttatgcttcactgagaaaggttttcctgaccacaagataggaagaaaaaagttcttttaaaatgtttatggtttcaaaaatgtgtaggtatttaatccgcatggaatttattttgggattgtggtgtgaggtggtgggtgatggaacttaaacgggctaacatttggggaaagctatcataaaataaattcccgcaatcaaataaattgtggtaaacactgtcccattttacaaatcgatttaatggattcttcagtctactccatgtttttcaaattgaagtgtaacttattacagtaaaattcactcttttcagtgtacagttctagaagttttgacaaatgtatatagtcatgtaaccaccaccgtatcaggatgtagaagaattctaccactccaaggaattccctgttgactctttgtagtcagcctcccccaactctcagcccctggcaaccactgatttgtttgctgtccctataattttgttcttttcagaatgtcctgtaaaagaacttatgtattctgtaggcttctgagcctggcttctttcacctagcataatgcatttgaggtttatctatgttgcacggatcaatacttcattccttactgttgctgagcagtatcccaaagtttgtttatccactcaccaactattgatgattatgaataaagccaatataaatattcacatatggctttttggatgaatgtaaacttttatttcactcaggtaaacacgtagaagatggctatgttgtatgtgagctttatcaaaaactgataaccgggcacagtggctcgtgcctggattcccagctactcaggaggctaaggtgggaggatcgcttgaggccaggggttcaagaacagcctgggcaacatagcaacattcccgtccctacaaaaaaaattaaaaaattatctgggcatggtagcatgcacctgtagtccttgctactcaggaggctgaggcagacggatctcttcagccggggattttgaggctgcagtgagctatgattgggccactgcactccagcctaggcaataagagtgaaactctgtctcaaaaaagaaaaacaaaaacaaaaagaaattgtatccttttttcccacttcattttctatggtagtgagtaggaaggctatttaattgtttttctgtacatttatcttacattcaagccattttactgaacttttcttagttctaatagtttttcagttgattttcttggattttcaaagtagacagtcaaattgtctgcaaatggcaataatatagggaattttccctccaatatttttacctcattttattttcttgctttagtggctaggcttccctgtaggataatgttgagtagtagttgctactattttaccattaactattgtgcttgccatagggttctggtggctaccttaattatcctcaggatgtttcttttccattgttagcttgctaaaagtctaaaagtttaattttaaaatttcttgttctgcttggaattctttttttttttttcccattgaaagcctaagaggtttaggatcagttagtttgcttcttgactttggaagttcatattttgatctcactggaggagaagttagtgtagcattaagtcaattcattttattttattttatttagatagagtcctgctctgtcaactaggctggagagcagtggtagtaatctcggctcactgcaacctccgcctcctgggttcaggtgattctcctgcctcagcctcctgagtagctgggactatggcggcgcaccaccacacctggctaatttttgtatttttagtagagacggggttttgccatattggccaggctggtctcgaactcctgacctcaagtgatctacccggctcggcctcccaaagtgctgagattacaggcatgagccactgcgcctggtaattcattttatttagatgatgaagaacctacctttggaggtttttttaataatgttcttatttgggggaatgctgggtgtactgaggaagaaagagaatcaagagacagtttataacctactcatgtataaacaaggtagctttttctagtgttcaaactttttttgcccaccattcacaataagtacattttatatttctttttttctttcttttttttaattttttaatttttttttttgagacagagtctcactctgttgcccaggctggagtgcagtggcgcaatctcagctcactgcagcctctgcctcccaggttcaagcagttctctgcctcagcctcccgagtagctgagattgcaggtgcccgccaccacacccgactaattttttttttgtatttttagtagagacgaggtttcaccatcttggccaggttggtcttgaactcctgacctcatgatccacccgcctcggtctcccaaagtgttgggattacgggcgtgagccatcacgcctggccacattttatatttcagctcagtccaaacatacttgtatataatggaaacaaactctcacaaagtctttgtctttctcctgtgtgcaatgtattgatattttcaattatctttcatctgttctatttcattttaaactgatgatcatgattttccaaattgatttgactaccctttcatttgattttttgacccacagtttgaaaaacattgttttgtaaaactgctcatttagtttctaagtccccaaactgctggattatgtccagaaccgattcattttatatcagatcctgctatgatgcaaagtaagttcatttattatgctctgagatcagtgtaactacctatttctctcttgaattactgtgtagcctctaaaccagtctttcagtgtctacttttgaccccacagaatagccaatacatgcagtcttataagtccatgactcaaactcctctaatgacctcttcccacactttttttttttttttttttttttttgagacggaatctctgttgctgaggctggactgcagtggcgcgatcttggctcactgtaacctctgtctcatgggttcaagaaattctcctgcctcagcctccctagtagctgggactacagtttcacacctccatgcctggctaatttttatatttttagtagagtcggggttttaccatattgatcaggcttttctcgagctcttgacctcagttgatccacccacctcggcctcctatagtgctgggattacaggcatgagccactgcgcccggactttttttttctcttgagacaggatctcgttcttttgcccagactggagtgcagtgtcatgatcatggctcactgcagcctcaaccttcggtgcttaagcgatcctcccacctcaacctcctgagcagctggaggcactacaggcttgccccaccatgcctggctaatttttaaaaagtttttgtagtgacggggtctccctgtgttgcccaggctggtctcgaactcctggattcaagcaggcttcctgcctcagtctcccaaagtgctgagactacaagcatgagccactgcacccggcctgcacttttttttttcttagacgagatggggtctcagtctgtagcccaggctggagtgcagtggtgtgatcatagctcactgcagccgcaaactcctgggctcatgcaaccacacccagctaatttttgtatttttagtagggatagggtttcaccgtgttggccagtctgttgaactcctagcctcaagtgatcctcctgcctcggcctcccaaagtgctgggattataggcgggagccaccgcgccgcctcctaccacacttacaatcaatccctagggcctcactggtacctcctttactccctattctcaacttctccaaacacagcctcctccgtgcttatgttcctcacccaagccaagcgtttgctgtgctacctgcccagaacaccatttcaccagatagtttctttgtttcatctgagtcttctctaaccctcattctaaaaccgtactccccacttaccacaggaagggtccattcccttatcccacttttgttttctttatatcactgttacctgcaattatgttatttagttatttgtttactgatgctgcgtcttcttttccttcctggaatataagttccaggaaggcagggactttgtgtagtttgctcatcattgtgttgtcaggacttagaacagtgggacgtagtaggtgctttatccacgtgtcaaatgaccgaatgaatgagcctagaatatagataaaatctgacacttgtcctaagagaagtataatgtgccctgcctttctgttccaatgttagtgtggaaatttctttaggttaagcgtggagtattttaatgtaagcagttcattaaccaatacacactcacctggtatccactatatttctgacactctcgtaataataatgatagctaatatttactgagcagttactacccttattgctttacatctattaactcatttaatcctcccaacctcttgaagcaggtacaattctcatcattttacagatgaggaaactgaggtacagagaagttaagttacttgtctaaggtcatacagaaggtaagcagtaggtccggggtttgaatacagaccatctgatttcagagcctgtgttcttcatcacaagctcctagctagagcaaggagtgcgcacaattcctgacctttgtaagcctgtcacgtttatggcttagcatagtggttctcaactggaggtgatttttgcctcccaggggacatttgacaatgtcaagagacatttttagttgtcatgactggcagggtttggaggtgctactggcgcctagtggggagaggtcgaggatgctggtaaacatcctacagtgcacagcacagcaccctcaccccaacaaacagtgatccggcccaagcattaatagtgccaaggttgagaaaccctgccgtggcacagtggttctgaaagcccgctgcccactggaatcactgggggagcttgataaatcaataccgatgtccaggtcttgttcctgaccttaataaacctcaaatggaccttcaacatggcctgcagtcctaccatgcttgcctagtgggtttgtttttccattctccaaaacagttgtttgacaccttttatttcctctgcccctcctagatcagttgctgattctggctcattcaacaggagcctcctcataacccactacctggacccccaacaggcccatatttgtgcaaataaagtgttccccagtgccactgtgaagctgtgactgaaatgcccctaatggatcaaaaactggctgcttttctgggctctgggtccctcatcctctttgtcttctcagggactttttttttttttacttttttttttttttttttgagacagattcttgccccgtcgcccaggctggagtgcagtggtgcaatctcggctcactgcaacctctgcctcccgggttcaggtgattctcctgcctcagcctcctgagtagctgggaccacaggtgcccatcaccacgcctggctatttttctttgtattttcagtagagatggggttgcgccatgctggccaggttggtctcgaattcctggcctccggtgatccgcctgcctcagtctcccaaagtgctgggattacaggcgtgagccaccgcacccggccttaacgttttatttggaaataattttaaactttacaaatgagctgaacattttttttaaaaagtacaaagaacaccccatgcccttaatccagattcctctgttgttagcattttatcctgtttgctttatcatttacactcttgctcgtgtacctaggattttcctgaaccatttgaagataaatttcatgcagcaagaactttaactcctaaatccttcagtagggatttcctaagtataagaatattctctcaaataatcacagcgctgttatcaatctcagtaaatgttttgataagatactgttatctaatctgccgtttgtattccaattttgacaatagacctgataacatcctttacagcatttttttccttctagtacaggatccagtttagggttgttgcattgattgattgattgattgagataggctggagtgcggtggcacaatctcggctcactgcaacctctgcctcccaggttcaagtgattctcctgcctcagcttcccgagtagctgggactacaggcacgtaccaccactcccagctaatttttgtatttttagtagacatggggttttgccatgttggccaggctggtctcaaactcctgacctcaggtgatctgcccgcctcagcctctcaaagtgctgagattacaggcgtgagccaccgcaccggcaggtttagagttgttgcatctagttgtcatgtctcttagtctcttttagtctggaacacttctattgcctttctttgtcctttgtaacgttgattttttttttttttttggttttttttttgttgttgttgttttgtgtttgagacagagtctcaccctgtcgccaggctggagtgcagtggcgcgatctcggctcactgcaacctccatctcccgggttcaagcaattcttctgcctcaaccacccgagtagctgggattacaggcacaagccaccacacccagctaatttttgtatttttagtagagacggggttttaccatgttggccaggatggtctcgatctcttgacctcgtgatccacctgccttggcctcccaaagtgctgagtgctgggattacagacaggtgtgagccaccttacccggccttttttttttttttttaatagaacattaatcatgtctggtttgtctgatgtctcttgtgattggactcaggttatgcatttttagcctgaacactgcgtggatgacattatatccttctcagggtatcttattttggaggctcataatgtccatctcttcctcattggtgatgttaattttgatcacttggccagggcattgtctaatttctccactgtgtagttattggtttttctttccaaatccacagtctgtgggaagacacaaatatcctgctcaaaatttccctctagggccaggtgtggtggctcacgcctgtaatcccagtactttgggaggcttacttggaggatcagttgagcccaggagttccagaccagcctgggcaacatagtaagaccccgtctctacaaagaaaattaaaaaattagccaggcatggtggtatgtgccagtggccccagctacttgggaggctgaggtattaggatcacttgaacccaggagatcgaggttgcaatgaaccattatcggaccactgcactccagcctgggtgacagagcaagaccctgtctgaaaataataataataataataataattccctttagatttagcatccagtgatgatttttgtatgatctattctttaatatggttgaaaataataattttcgactctagtattccctccacatttggtccagagcccttccttctcccctatttattgattgattcatctatttatttttggtatcaaataattcatattttcaaaataggtctgcaattcattactatacttaattattttagtgcacaaattgtaaaggacttaattatgcattgtttccttctctcttttctgcctaatgaactcctctctccctgttctagatcattcccatcagcttacaatcctgctctaatgtctaatatcttcatcaattccatattctcctccactcattccccacccccatttctagtcactccttctcagaagatcttcttaaaaggatgctcatattttatcacaccacattgtcagtcctcagtatatccacattggcaaatacagccatcacttctttacttaccatgttttacttggcggcagcatttgacagtcattccctccttctttgaccactttcttgttgtggcctccagtatcctacgctctcttggttttcctatctttctggtagctcattctaagtctcctcatcctctcttctacctatgaaggttgatgtccctccaaggcactgggaactgttcttctctttctacctactctcctgggatgagcccattcattcctatggctttccattccatctagatgccagtatctccagttgtgacctttcctacacttaagacttaataatttgcatgaatctctaagaggcatctcaaactcaatattttccaaagcaaaatcctgattccctgtcaccctcatgcaaaacctgattctctccctgtgaaatccatctcagtccatgacatcaccattcactccatcgttcaggctccacacctactagtttcatgccccacatccaacccatcaacaaatcttgtcaatttggcttctaaaccgtatcccaagtcttcccacttctctctactcctactattccactatacttccatccttctccgtctctttcttggatgattgtagtggcctcctagaatccaatatccacatggcagctagagtatcttcttaaaagcattagttggattgtgtcattccctactggactatggaagtctgccatgttctagtccctgcccctcttctatctctcttgctgactgtgcttctttattgattcttccagcacattaacctcattttagtcttttatactaactgttctgcctggaatgttctttctgtcctctactttatcttctgtttttttgttttttttttttgtttgttttttgtttttttttgagatagagtctctccctgtcacctaggttggagtgcagtggcgcaatcttggctcactgcgacccctgtctcccgggttcaagtgattcttgtgcctcagcctcctgagtagctgggattataggtgcatgcaaccacacccggctaatttttgtatttttagtagagaagatggggttttgccatgttggccaggctggtctcaaactcctggcctcaagggatccacccgcctcagcctcccaaagtgctgggattacaggcatgagccaccgcgcctggtccctcctttatcttcttattgctggttcctcatcattcagatctcagtttaaatatctcctctttgatgacctgatccaaaatagccaccaggttaccttctatatcatctcaccttactctaattctcaatgctgtatttattatctgttaatttccttgttgatttgtacatttattgttctcttctcctccttccaccctcctcacactagaatgtgagcagggtccacatctttacccccagtgcctagaatagtatttggcatgtagtattcaattttggtgtttaataaatatttgatgaataaatgatacatttaatccttcatgcatgattctcagcacatggaagatactcactaaatgtcctcttgttgtctttccccaagagtacattcttgtgtctggggctagtctagaagtttccagtgaagacaatcatctgataaagagattcatatttctgtgttaggatcctgattattagggtttctagacaaaggggaattacattttaccaagaaaaaaacagtgatagaattccagggatcattagtgtcacatttttcagtgtgggactttcctggccctcctaactacaagactggttctcagattccacaaaatcgacatgttttatcttgggattctgtcgtgtaaatttttgaaacacttcatttgggaggatcacgtggatttttaggtgggaagaaggggatagcaaaggaagtggcattcttctctgcctttgttaatagtatcatttcctgtgcccatttcaacgttagctctggtataacacaagtgataagccgtgtgtgttattgaaatctgagaaaagggcaccaaaaaatgtttagtactttgtactggtctaaaattcatgacttgaatatgtggggagagagtgaggaagattgggaagatgtatactgaagtggtttccctttgaggtattatttgaagattggtgtgatttttgggaaagctcttgtagtggattttaaagcttccaggaaaaaatctgtaccaatgaacacgactaatgattttgtcagcagatgattcgctttttgacagaaatataccacatgtttttggggtatttggagaaaccatcacccttgacccagtaggatttttttttaaactgggccaaatgcttattgtattcacagttcatacatgagtcaagagctgggcgccattactcagcttgtgatattgatcacctgttcatcacgattcatcatttcaagcagccatccttatgaaagcaggcaagtgtgtcaagtagtatttcatggacatatttagagcgttcttcttcttccttcttctttcttcttcttcttcttttttgagatggggtctccctatattgcccaggctggtcttgaactcctgggctcaagtgatccttctgcctcagcctgagtgttactctctttgacttatccataaaagtggatccaatgtgtctacatatattttttaaattaaacttttattgaagtacaaattatacacattacaaatgtacagctcaatgaattttcacaaactgtgcatatccctgtcaccagcccccagatcaagaatcccacacaagcagcctttagaagccctcctcttgcctcctttcactcactgccccccaagggtgactactgttctccctcaaatgccacatattgtgcctgttcttaaatttcctatatgtggtaccagacaggctacctgacttctgctcagtattgtttgtgaatttcctccatatcgttgcatgtggttatagttgggtgattgtcactgccgaataatattccgttgcatgattaccatggtttatcctttctactgctgatggcctttgtttggtttccagcagttttggcttttatgagtggtgctgtgggtgattctcttgcctatcttgtagtgaacatatatgtgcattactaccaggtaaatacctaaaagaatgctttaaatagattattaatagtttttatggttactgtcaattattttctcctctgaatgcaattaggattagtagccacctttggacataactcacacatctgtatccatagacaatgatgagactttctttctgtaactttttttttttcttgaactcctcaagcaacctgcccgcctcagcttcctaaactgctgggattacaggcatgagccaccgcacctggctttctgtaactttttttattaagttctagcattagttgtttttacactttaattttcttttttctttttttttttttttttgagacggagtctcactgtcacccaggctggagtgctggagtgcagtggcgcgatctcggctcactgcaaccttgtgtcacctcccggagcgattctcctacctcagcctcctgagtagctgggactacaggtgcgtgccaccacacctggctaattttttgtatttttagtagagactgggtttcaccgtgttagccaggatggtctcgatctcctgactttgtgatccgcccgcctcagcctcccaaagtgctgggattacagacgtgagccaccgcgcccagcctatactttaatttttttctaataattggtttctatgctgattttttcctttaccaactacctatatcatatcatcattttaaaatatcttaagaattttagcttgctttttcttttcctgcctgcccccaccatccccacccccagctgtatttcttttgaaatgaaaaaaaaaaaaaaaacaaaaaacaaaactcctggaactgctgaatgtgttttgcagatatagaggtaaaggtttaccacccgaatagctttagaatggtacaggcttattcagcactgattcctagtcttgccaaggaaaagtaaaaaggacaaagaaaggaagaaagaaggagggttaaaaaactaaattatgctttattttgtggtgtattggttgacagtagtatttttctctgtctcctctcagctaatctggtcatttgaccaactggatagagcaaatattgtctgaaatgaagcaaatacattccatttgattttggtgggagacaaatttttaggcagggaaaacgattagcagatagtgtcatgcacagcagtgcctttcaaatgccaacatgcaaaacgattgcctggggatcttgttaaaatgcatatgcggattcagcaggtttgggactggccagagatttctgcattgcagctcctaggtgaggtgatgctgctgttggggcgggggagctgcactttgagtagcgaagctttagaacatagctgcctccatgttcctggggattatatggagcatttgcccgttgcccactgatggatgataaacagctctcccaagtacccctctgggcttgtcctctcagcactgccggcagaaccaggttgtgtgtagcctgcattaaagcagcagacaaagcccagggctcttcttttttttttgagacagagtctcactctgtcacccaggctggagtgcagtggcatgatctcggctcactgcaacctccacctcccgggttcaagtgattctcatgcctcagcctcccgagtagctgggattgtaggtgcccgccaccaccgcccagctaatttttgtatttttagtagagacggggtttcaccatgttgcccaggctggtctcgaactcctggcctcaagcgatctgcccacctcggcctcccaaagtgctgggattacaggcgtgagccactgcacccagccgcagtgctctttttttaacctggaatagcaacttctttcaaatctccctcacctggactctcctcaaatatctcataacacctgaagaaaaaccactaacctcaaacacacgccaaaccgaaacacacacacacacacacacaaacacacactatcccagatactgacatggagaaaggagtggggtggggcaggcattaagccactcttttttctcctggcttcactatcgcacacttcctcattcattccagagcaactaggtgtctgtttcaacatccctggccccaccattatagtacacaccagtcaccttccagccacgagctgcacatttctctgtgggggccctctttacacatccatgctgcaggttggaagtgccagggaattaacagctcccaccccaccccaggagcagccttcaaccaatgcctgatgcaagtcagtggatccataccctcaagtgggataattcagaccggtgttctacactggctcccagaattccccagaaggactaaactcccattgcccccagtggtgactggcttgataacgccatctattggctgccttcctgccccaactcacgtgtccattctatctgtgtttcctggggtcacagcccagataaactacttatctcgaatatgtgccaaagagttaccttcttcttcttcttctttttttttttttttttttttttgagacagagtctcgctctgtcgcttagactggagtgcagtggtgcgatcttggctcactgcaacctccgcctcccaggttcaagtgattctcccaacccagtagctggaattacaggtgcacgccaccatgctaatttttgtatttttagtagagacggggtatttcagctaatttttgtatttaaaaaaattttttttattatactttaagttctggggtacatgtgcagaacgtgcaggtttgttacataggtatacacgtgccgtggtggtttgctgcacccatcaactcatcacctacattaggtatttcttctagtgcttttcctcccctagccgcccatccccctacaggcccccgtgtgtgatgttcccctccctgtgtccatgtgttctcattgttcaactcccacttatgagtgagaacatgtggtgtttggttttctgttcttgtgttagtttgctgagaatgatggtttccagcttcatccatgtccctgcaaaggcctatttaacatggcctaaatagcaactaattatagttggatgattgtcactgccaaataatattccactgcatgactaccatggtttatcctttctactgctgatggccttgtgtataatttgtactacaataaaagtttaatttaaaaaatatacatagacacattggatccactttcatggatgagtcaaagagaataacactcaggctgaggcagaaggattgcttgagcccaggagttcaagaccagcctaggcaatatgggaagactccatctcgaagaagcagcagcagcagaaaaagaaagaaggaagaagaaatacaaaacacataatttttgtatttttagtagagacggggtttcactatgttggccaggctggtctcgaactcctggcctcaagcaatctgcctacttcggcctcctaatgtgctgggattacaggcatgagccaccacgcccagccttggagttactttttttttttttttttttttttttgagacagagtctcgctctatcacctagacgagagtgcagtggtgtgatcttggctcactgcaacctccacctctcgggttcaagcgattctgctccctcagcctcccaagtagctgggactacaggcacccgccaccacccccagctaatttttgtatttttagtagagacggggtttcaccatgttgaccaggctggtcttcaactcctggcctcactcaagtgatccacccaccttggtctcccaaaatgttgggattacaggcatgagccaccacacccagcagagttaccttctgaaggaacccaactaaggcaaaactggtcaacagtcaggaattccttttgttaattttaataaaatcctattataaaaaaagggggagccccatggggtttcttctgaggggcatctcaccagtatctagatattttgtctgcgtgacaccaaacagtcagatggctggaaataagcctgataatggagagaatgcttctctgttcccgggctgttttgggatctggtcaacagagttgattttctggacaccccagtcaagctagttcaggtctttttgacctgtacccagagggtgtatctctgagttctgcctcagaagcttgatcacatcccgggggctcctacaaaccacatcctggctgcagccaactcccttccacaggcctccctcactgagtttctctgtggtgggttctctgcatagcctcttgggatgaggagtccttctcagacctttacagaacagagcccctgacactcagtttcaagggcctacctacatccgtttccgaagctttgcatcgatggtcactgctcctcttagccatgtcctcagctttctcctcctcctgccttcttccccagactgaagtggatctgaaccttggcacaatctatgcctcttagtgcattttaggggattttagggctgcctgggcccctctatatgttcagacgtgtgataggacccagccttttcccctcaagaccttgtatttgaaattccccattctatggtttgtctcatctttggaacccacagcaggcagagatgtttgggagggtggcctcactgggcacactgtcctggatgtctcacagttttgcatacctctgccaggctgtgctgcccccaggccagactcctgtttctctgtttgggcatcttgggggtcctaattagacacttagtcctttggatttggtattttgagagtacacgtggtatcaacagggctagctttaatgttaaaacatctattaaaacaataagggtggatggctaggtgactgctactgttactaaaagaggtcccgatccagaccccaaaagagggttcttggacctcatacaagaaagaattaggagcaagtccatagagtaaagtgaaatcaagtttattaagaaagtaaaggaataaagaatgtttgctccgtaggcagagcagtggcatgggctgctcgactgagaatacttagagttatttcttgattatatgctaaacaagaggtggattattcgtgagttttctgggatggggcagggaattcccggaactgagagttcctcccctttttacactgtaaagggtaacttcctgatgttgccatggcatttgtaaaccgtcatggcgctggtgggagtgtttttagcatgctaatgcattataattagcgtataatgagcagtgaggacaaccagaggtcatttttgtcgtcatcttggtttttggtgcattttggctggcctctttaccgcatcctgttttatcagcagggtctttgtgacctgtatcttgtgccgacctcctgtctcatcctgtgactaagaatgcctaacctcctgtgaatgcagcccaacaggtctcagccttattttacccagtccctattcaagatggagtcactctggctcaaatgcctctgacactaccctgtaactttcttagtcaacttgggctgccagaacaaaataccatagattgagtggtctaaacaacagaaatttatttctcttaattctggaggccgagaagtccaagatcaagatgctggcatggtcaggttctggtgagttccctcttctgggtttatagacagctgccttctcactgtgtcctcagttggcagagagaggtgggggaagcggggagggagagggagagggagagacaggttaccctgggggttagggcttcaaaatatgaatttggcaggagggacacacaagtccacagcaataactgtgcatgactccacccccatctccccacccccaccagtatctcatctgttgatctggctgaaatctgaaattccacaattagagattcatttccttggtttaaagtgttataatttaaatgagcacagaacctggtcgatgggcctccatgcgaggccttctcctgagagccagtgaaaaagtatgaggtcactgggcacctacaagttgggaatggcccccacctagaagacacaaagagtactaaagaggaaattgattttcttcaagtgaggtgggcttgttaactttgccaaggcctgtcctagtcctcagagttatgttcatatcagttcctgcaaaataccccttaaaataagagaaatgagtccttcatcttgcttttttgcatctatgagtgatgtgaaagacattgccttttaaagagggagtccaggccgggcgtggtggctcacacctgtaatcccagcactttggtcttgaactcctgggctcaagtgatctgcctgccttggcctcccaaagtgctgggattacaggtgtgagccaccacacccggcaatattttcaccgcaatacttcatcttcctcccctactaacatccaaatggtacctgaagtaaagcgagccacttcttatggcttgttattgctgggaacagctgcttgtggataattagctcaggcaatcagaacactgggtcaggaaatcaggcacgtgggtctgactcctgtatggcctttgctcttggggacctgttgagggtgggtcactgctggttcagtatgtgctgcatgtggaattccatcccctttgaacctgtaccattaatggggtaacagctggaggtgcttaactttggccctgcatcagttttcaaaagtgcataaaggtaagcactatcctgaaactgttgtttatctttctcatacatttctttttttttttgagattgcgtctcactctatggcccaggctggagtgcagtagctccatcccagctcactgcagccttggcctcctaggctcaaatgatcctcccatctcagcctcccaagtagctgagactacaggtgcacaccactagggtcggctaatttttgtattttttgtagagaaagagtttcaccatgttgcccagactggtctcgaactcctagactcaagtgattcgcccacctcggcctcccaaagtgctgggattacaggcgtgagccaccgtgcctggctatccttctaatacatttctttatattttcctacataggaatatgtccttaagcaagagagaatgctactcgcatgccttttaagctttataagattggtgtgttttttactttcacattttgcaactttcatctcatttaatactatttttgtgagattgattctcttggctacatgtagctctagctcatttttcttcctttgctttatccacaaaccactcccagagaacaactgaactcacagttgccagggtgggggaagagcaggaattacacacacacacacacacacacacacacacacacacacacacaatctcatgattagttgatttgaaacacacctcaagctattctcataactaaatcttaatccaaccaataattcctttagattttaaccacttaactttggaaattgttttataaagctctagttcttccatatgttcacaactcacaaaattggttttgcaaataatccttttaccctttgcccgcgaggaatcgcaaagctgagtttgctttcatttgccatcgcttttcttcccgttttcagatgtcgttatctttctgtttccttttttacttggcatagatttgccttcctttcccaatagtatgtccaactctttcaaaacctctccattcattcagccatgcattcttttcacatatgtttataacatccctagtatgtgccaggcacttttgcaggcactggggactcaacagtaaaccaagcagacaaaacttctgccttcggcaaagaagcttatcttccagtgagtgaagcagacggtatttgagtaaaatacacggtcagttagatggtgttaggtggtgtctgtggaggaaaatgaatcttgggaaagaggcacaggaagccgtgaggggttgcaattttatatagcatttttctaggccaggggttggcaaaccatggcccaaggccctccatctgtttctgtaaatgaaggtttattggaacagagtcacgctcattcacttacatgttttccatggctgcttttgcattgcaacagcagagttcagtcattgcaatggagaccattttggctgcaaagcctaaaatagttcatatttggccttttacagaaaatatttactatttgaccctttgcagaggaaatgcagatttttacctatgataacttttgaggattctacccatgttgtgcttttcagcttctaaagcgttgtcaggaacacgatgtcatctgagtgttgaagtagtgtttgttatgaggtaggtctcagtagctttgttttacaggtgactcaactgaggcttgaaggggttattatggttgtccagggttgctgaccttgtaaagtggtcgtgttttttggtgtttttttgagacagggtcttgctctgttgtccaggctggatgcagtggcatgatcatggctcactgcagcctcaacctcctgggctcaagtgatcctcccacctcagcctcccaagtagctggaaccacaggcatacacaaccatgcccagctaatttttgaattttttgtagagatggggtttctctatgttgcccaggctggtctcaaatccctgggttcaagggatcctttcagctcaggctcccaaaatgttgggattacaggcatcagccactgtgcctggcctaatgctggtgttcaactctaaaagctggtgcgttttctactttccagtgacaaatacaacccaggtttttagcgtgacgagcttctaagcacatgaaacacagataggcaatcacgtgtaggtgtcacgaatgtgggctcagaagctcagcagcccaagttcaaatgcttgttctgccacttacctttgtgacatcaggcaagttatttaacctctctgtgccctgcctcagtttccttgtctgtaaagcagtcataattgtatgccttctaggtcaggtggtgctgtatcttggttttgccaaggcagctctgatttatgcctgttttttccacattaatcaatagtgccccattttactctcacatacccccatttggacattaaattatgtgcatgccctaaccagggtcgttgcagagattaagtgagttaatacaaataaagcaagttaatacaaataaagcagttcaatccatgctgtaggaagcatttgctagactttggctgttgtttcttgtcaaggccatgccagcccatcacttaatttttttttttttaacttttttagatggagtctcgctctatcgcccaggctggagtgcagtggcgcgatctcagctcactgcaacctccacctcctgggttcaagcagttctcctgccttaccctccagagaagctgggattacaggcgcctgctaccacgcctggctaatttttgtattttagtagagatggggtttcaccatgttagccaggctggtctcgaactcctgacctcaagtgatctacctgccttggcctcccaaagtgctgggattataggcatgagctactgtacctggcctcacttaattttcttctgacccattgctttgtcccattaagtctgaactgatttctgtctggagcaattttgcttatctgggttaataggtgattgaggattcatcttctgtgtggcagtgccttctggctcactccctgacctcccttagcagctttgctcagatgtcatcttctcatgatggtgtcacaggacacctctctaaaattgctacctcccccacctccaacacacttcatatccacttctctgctttatgtgtttgctttatagttattactaacatacaggttttactgagctactactgatgtggttctgttttgctgttacttggataaaaaaaaaatcctacaaaatctgctatgcctgtgagaatatttatttttatgttttaaaaaaatgtatctttatcattacattttcagaaattacagaaaaacccagtaaaaaattcagcccacccatggtcccccctccagttggcattttgctgtgtatcaagaatacagcaattttaccccacctctagagggagtacattttctaatctaaccatataactttagctaaacagcttacaagcaaatgacagtttactatgttctctaagtattattttgattcctttaaaaggagatttttcctacacattttcatctgaagctggcctaggaggaaatataaacacactggtctagcctagtcccatctctagaagtaaaggaaaaaaaaaacatagaagagaaattgagtgaaaaggcatgttccctcacttgcagttagctttctggcacggtggcaaagcattggcctggcgcctgccaaaatgagcatcttaatagaaattatcatgtgtgacattcctttgaattgctaactttctttgtaatattgagcaagttgctttttgcatcattgatataattcatcttcttatgtgtttgctttatagctctctttaaaactgtcagtgtttcacagattgatccatttgcgtttttatttgtttgaatgccgcactggcacgtacaacccaaaagggcacagttgtgtgtgtcttgttcaccactgcactcctagcacctcccgtagtgcctagcacatggtatttacttaataaatatttgttgaatgggaaggtgcctgagcacagcagagtacgctcaccctcgatgcagtgagggtgtcctgccaccggggccggggtggggaggagatgacccagtataaggtcctcagctgcgagagaatgaacctccaaaatgtggtcttggtccctcaaatagcattcacactttctcccccaggccccggattcctgtaacaaaggataagtcattaattcagtcctccgagttggtttaaagaacagatgcctttgttttttttgagacggagtctcaccctgttgctcaggctaaagtgcagtggcgctatctcggttcacttcaacctccacctcccggattgaagcgattctcctgcctcagcctccccagtagctgggattacaggcacctgctaccacgcctggctaatttttgtattttagtagagatggggttttgccatgttggccaggctggtctcgaactcctgacctcaagtgatccacccgccttggcctcccaaagtgctgagattacaggcgtaagccacaacgcctggccaaagaagagataccttttgagagaggaagctcaataggaccttcacacgaagaggtcaggtgtgatattagctccattcctgggacagctgtgatcaagtgggagcggaaagaagagcataaggaggggaggcagagaggggctgggtggagtggcatggccaaggaggaaaacatgcaggaagggcagcaggcccatgccagacctcttctcttctagaaaagcacatgaagtgtcagccacagagatgtatgtggagcaatttgcagagtgcctggtgcccggaagcagttaacgatggcactaacactcacagctaatatttttgagcatgtgctctaagccaaagtctgctaagcactttccctgtactgactgactcattactcataagaattttaggacataaataagaagtttatccccatttgatgggtaaagaatcccaggtatggaggcagtaaatatcagcaactactttatcccatgacttgtgataggctacaattaaacactggctgttatcatcatgactcactgaaaatacctcaccacctccctacacctcccttttttctgtaatagtgaaaaggctttgacaatgttgtcaataatgtggcattagtactataggataaccaaaagcagcttgtaatatttatggcaagggagttttaaaagatcttttgagatattgtacacttgttcttacttgcatgagcacattacatttttatccaggcagaatcatttttctatcaaatggtagttttcaacctattgctaactgcaatactgattttttttttttttttttttagatagagtctcgctctgtcacccaggctggagtacagtggcgcaatcttggctcactgcagcctccacctcctgggttcaagcaattctccctgcctcagcctctcaagtacctgggattacaggcacatgctaccatgcctggctaatttttttatttttggtagagacagggtttcaccatgttggccaggctggtctcaaactcctgacctcaggtgatccgcctgactcagcctcccaaagtgttgggattacaggcgtgagccaccgcacctggcctggtccatttccttttaaccctgcctttccaatgagaacctgggagatgattaaaatattccattttatatgtacactgcactttaaaaatttttttaatttaattttttgagacaagggctccctctgttgcccaggctggagtgcagtggcacagtctttgttcactgcagcctcaacctcctggactcaagcaatcctcccatctcagcctcccaagtagctggggctactggcacatgcccccacacccagctaatttctgtattttttattgagatgggggagggtctcactatgttgcccaggctggactccaactcctggactcgagtgatcctcccaccttggcctcccaaagtgctgggataacaggtgtgagccattgcgcctggctccccggcactgtttttactataaaatttttcagctgtccccgagactagattatgtgattactttattttggatgagagaattgatgtttactttttcctcagcattctatttatcattctaattaacaagttaccagtttcactaataaaatgcttttggcatttgatatgctgattagcgaagtgtggattgtaggtcaaggtcacaatggcagaaggacgtgtaggagctgccttgagagagtggcctttgtgctataaagtttgcagagcactcatcgagttcaagcttaaactcaccggcacacacaaacatcacactgccttccctgcggtatattaaagtgagttccagacctcataacaggcaggcccggggcacctcatggttcatggaggctttggggtacagtggcaagtgattagctttgggagtaacatgactcatgtagtctcccgttttctcaaattatctggtgagttagtctcttactgcaagggaaaaaataatactcccacaccacttggaacaccccagttttgggaaaatcactcaaaaaatgctgcttagccacccatgcagcatccgtgctgctggagggtcatttgggaaaaggcagcgtccagacgcctgcgggaggcaggatttttatgggctgtttttgtgtccagtttcgtagttttcagaggagtccattcaggctgtcaatgggaaccgttgaacctgtcaagttgctgtttgccgggtctcttggaaaaacacactgcaacatcccagccctgggcgggtcagagaggatagtactaaaaaaagaaggagaaagtggacggccccgctctggtgggaggccagggcttggggctgcagccaagttccctggtgatagaggagtttccaccatccaaggcttcccgttctggctccctccaccctaccgtacaccatccagccttccaaaataactccgcttccggtggaaccgggcagagtcactggaatgcgtggtaagcagaaggagcaggtagagttgatgctgggagagaaagtgttttgatgagcaaggaaagaaagtcgaacaggaaggccagccagccactgcaagactttcctggcagtaggaacactgatgggaatggcactgacttccagtttctgaggcgcagcccagcaaacccatcaaggtaggcaaagcccttccttgggagtcatccccatacctcctcctcctctctctcccagttaacagcaggccttcccatcccaatgtgcgtgcgttgtccatgcctgacctcactgggctctgcctggtcactgaggcctgctgtatccctgttcaccacccaaactgacctgatcattaaaaaaaaaatagatttaggaggtacaattgcagctttgttacatgaaggtattgtgtattggtgaagtctgggctttgagtgtaaccatcaccaggatagtgtacattatagccgttaggtaatttctcacccctcacctacctctcaccctccctgctttctatccatactgtatgtccatctatccatactctgtgtccatctatccatactctatgtctatccatactctatatccatctatccacactctatgttgatctatccatactctatgtccatgtcacattatttacctcccaattataagtaagaacatgcagtatttggctttctgtttctgagttaagataatggcctccagtttcatccatgttgctgcaaaggacatgatttcattctttttcatggctgggtagtattccatggggtgtgtgtgtgtgtgtgtgtgtgtgtgtgtgtgtgtatacctacataccacatttatgtccaccattgatagacacttaggttgattccatatctttgctattgtgaatagtctgacttgataaattaagtcacacgtgcccattagtgaccacagtcattgaaatttgcatgttttattgggtgcaagcccttaccaaaaaaacaaccaaacaaaaacagaaacaagccttgagaggtggtctcttagatactagtcaaaaattaaaaacaacttttggggtggaggaggagtcctactctagtgaagtcttaatagactctaggtcaccgtcatcttcagattctctggtatagaacatgtttacatgctccctgcccgccatctccccaaacacacaaaagatagaatcagtcactcccatctttgtgtcctcaaagcagtgttcttatgaccatgagcacgttttctcccactgttcatccacgcataggagtgaacatgtgagtttcttgccttctcagaacgttcccctttatcctctccttgtgcacacagactggcctccatttagaagaggggctcagtcaagggccacaacttcctgcagactgtgggatctaccattcaagactgctgagaggaggagtaacctgagatctgagaattgtgccaaggtggaagttatgaccttgataagaataacacaaaagcccgattgaaatcagttcaggagacgctgggaagaggaagtggaggtgctgagtgtggccaaaccctgagcaggttagttgaggactagctaagaggaaaagcttggccttctctaaggattgtcatgttttctcttgttcatggatgagatttcagaataaaacacgatccccttttctatttgggcaccaaagagccatgtttgtagtttgttaatataaaggtgaaggccttgtgacctacttacctacttcctaacttcccagtttccctccttggtcctgatctccttctgtaatttatattctccttgatcctgcctttctttgcagggagtgaggaggggaatacaaagtgccgttttgtcatctgtggtcttggttgttaattgcctgttagccttcacagaacaagtgcaactgaaggctctaagacacaagtcaacgtgaaggtcctcctccatctcgccagacaactcctggactaggtcctggttcaggatgggtttgtgcagttgctgcagacagaggcaaggactgaattttaagatgctgggtgaggagggtgaggctggagggtaagagcaggtaaaaagggactgtgcataccccacttggagctgcaggactgctttccctctcttgctgggccaggctatggccttcccctgcagcttgggaagttactgtcctcgcacctgcccgtttgggtttcctctccccctcctgcctttgaccctgctcctcatcctctccagacacctgactccaagctcatctttctaaagctgctctgtctggttaatttcaccccctcccccaattttattctcgcccccatcaagttaggcattgactgtctactctgctaatttgttgtcattgatacctgacttattttcaagttgttgcaggggaactgatgtgagggaaaaagctggaaggtgttgttaactctgtagaaattgtatgtgactatgaaggccaaaagcatttcgagaaagcatcccatacacttgtaacctagcagcagtgggatgctgggatgctgcaagggctgggatcaaaggctgtggattgggctggcagagggccggtggctgtggtgggaaggcacaccagacccaaggggtggacaagttgtcagatgacctggattctagttcacatgcagctgcttcactgcgtttgatcctcacttgccttagctgaactctaggcagtgcctgccactctttcactctttatatccaacccagacccaagtcgcgtcaattcttcctcccaaatactgctcagtatgtccatcattcatcaccaccaccaccatcttcatccagccttgtttctcacctcgaataccgtaattacttcctcgttggtagagagcagggcaaactagcgcccacaggccaaatcccacaagctgcctgtgtttataaataaagctttattagcacacagccacactcattcatttacagattgcctgtggctgtttttgtgctgtaatggcagagttgagtaattgcaacagaaatcctgcagcctgcaaagctggaaatatttactatcttacccttgcagaaaagatctgcaggcccctggtgtagaggaaaatcatttgtataattattctgactcttcttttctgaactctaatacccattacattttaatagattttcgtgtgtgtgtgtgtgtgtgtgtgtgtgtgtgtgtgtgtgtgtgtgacataaaatctgtagtctccatttcttgattctaactcttactttgtatttttgttttactgaattgctcagaccttcagaacaatgtttgagaatggagagctaaaattccaaactggacccccacttccactaagaccccctcctattcattttccatgcaaaaattgctagaacaatcttgtcaaaatgtgaatctgaacacgctgcccactgtttaaaatccttcagtgactttccatggctctcaaagcaagggtgcaaatccttaccttggccaccaagcccccttgggagctgagccttttctgtctctccagcctcatctttcactgtcctctccttgccacggcatgtcctgtccactcctacctttcttcagttccttacatgagtgacattccctcttgccacagtgcctttgcacatattacttcctctacttgatacggtctttccttgcctctttggtgggcaagttcctctcacccttccagtttcagcatcacttccacagggaagccttccccagtcccttaggtcagatccccctgtcttcacccagagctcctgttgcattgctttgtggcacttgctgtaatcgcaatatcgcacttcttggtgtgaatttttgtatcatatctctgtttccccattagaatatgaacacttacccaacctcaacatctaatttgacctttctaaacattaacatcataaccacaaacaaataggttctgggacactaaggaaaaatcaacttttaaaaagtgcaaaaaaaaaatacatcattcaggagaaaaaaataagttagagtgagaataaagaataaattagaaatgtggaagaggaaagacaagcattttaagaaatgaccttctggcttctgagttgtactgagtggcttgatgtcattagcaagatgaacgtattgattttctcttatttgtatagtaaacaaatggaaatttaagcattttaccactcacagtacattgtttcctgtagttataaatatattttcttctttcttagcctgcgcagccacgtgagggagggggtcttaaaccatgcctcttaacccttgggcatctggctcgaaggcccattttcttctcctctctgctggctaggagcaatgggtagaagggagggctagaacacacttaacaggtcacagtgacaaatatttctttcagggagattatcatgagcaaatgcccagaaacgggctgcaaactctgcccagtgtccccagaaacatcttggttcatctctttatgagtagggcccatggaccatgcaaggtctgcagaatctgcttatgtgggttccagagggagtgtatagagggagtgtataaaagaaaatgaggcaggctttgaattagaatcagcccaggccagcattttatacataatgggcccttcccttaaattggtacttgtagtacttacagaaggaaaagaagaaaggaagatgagtggagagaaataatgaaaggaagaaagggtaaagaggaagggaagaaagaaggtgtataagttagttttttccacataacaaaacagcccaaaatttagcagcttaaagcaacaaccatttaattagttcacattttttgagtccacagtcttggcagggctcagcaagatggttcttctgctggtctcggttgggctcactcatgcatctgttgtcacctgccagtctaccagatgaccctttgcctgggggttggccagctcttggttggagcaatgcctgaccaggcgtgggtctttcatcatctggccaactagctcaggctggtttccactcttacatggtggcttgagccttaaagagcagcaagagagagcaaattccatgctcaagcacttttcacacttttggttgtatcacatttgctgcattcaaggggtggagcattcaaggggtagagcaacaaaatcacattgcatggattttgcaatgtaattttggataggcaaaatagataggcaaactagaataggaaaagtttggtttttattttatttttatttaacttttattttaagttcaagtatacatgtgcaggtttgttatatgggtaaacttgtgtcatgggggtttgttgtgcatattatttcatcacccaggtattaagcctagaacccactagttatttttcctgatcctctccctcctcccaccctccaccctaggaagagtttatgagtagctttgcaatcagccacaaaagggaggggctagaaacttctcttgctggcaaagttggcagagatacagcaattttgaggtggagtttgaggtcttcatattgaatttttaaaatgttattaataaatcactaaattcctatcttccacagtttttctgtcaaatagggctagataataatgtaacttcttaatcatttccagtgagaataataacaactttatgggcaagggtttcctcatcttttatttcctggagttaaggtttagtacatctcacgtggcagatatatatggaaacaggaaaattttaatgcaccagccttaatttgtagcccaagtgtccaatatacaacaaaggcttactaaacaaaggaaacatttatgtgtgtggttttcttactacttggtgagacccatcctacatgaacaattgctctttccttatctgtgtagcttttggtcgtattttctctcatcattgaaaatacaatatcaggccaggtgtggtggctcacacctgtaatctcaggactttgggaggcagaggcagaaggattgcttgaccccaggagttggagaccagcctgggcaacatagtgaaacccatcaagtagctgggtgtggtggcatgtgtctgtagtcccagctactcaggaggctgaggtgacagcatcacttgagcctgggatattgagtctgcagtaattgcgccactgcacttcagcctgagcaacagaggagacccagtctcaaagaaaaaacaaataaacaaacaaaaaacaaaaaagaaaagaaaatatcaaaagaaaatatcaaaacatagtttaaacagagggaaatggccagtgtttgttgctacccagtggaaagagaagttgagttaattagaaaatgttagtcatcttaattgagattgatttaagttgtgatgatccaaattcaattatcctgtgaagtgttttcatattaatggaagaaagctcactctggtgaactttgtgtgaatatagcttaatgtcagacttgcatttaaaaaatcaagtatataagtgttctttttgtgaaatagtaaattaatgtttttgtaaaagaattggtaaattcttgcctatgcatttgtgaaagtgagaattgtttatagtctaaggaaggttatgtcctgttttggaatgccttagttctgtcatcttgggtagagagttggtggttgcctcacccagaccactgggactggaggtctgggagtcatttgaaggtgaggctctcaccatgtggtctttgatactctcttctccagctctgggcagaggtgaccagcaacattctagcccccggaatacacgtggcaagccttaagctagggaagggaagggaaggaaaacggggacactgtagggtgaaagagagtagaagagaaaagagggagagaagactggagggaagggaagagagaaaagaaagcttctcgtgctgcaggaaaataaagcatggtagcaacggctgcaagaggcccactgacgacttctcctggctgcttccttccacctcagcatgcagcccctccagactgatgaccaggggtcatcttttgagatgttttacaaagcaattccgaaagctctgttagtcacttgtacaatttaacaaggatggacaccaggacactgtctttccactttaaactctttggctgtgccttggtttcagccatttcctctctttggaatgctctcgcccatgtcttcatataaagggagttgcaccctttaagctgcagcctgatgattacttcctagatgagattttcctggatccatttccccacactgggttaggtgtccttcctcggtgctcccattactgcccacagctgatgccaaagcctggcattctggattcaggctcgctggtgcccttggccgtgagcctttgtgcagggcacaacctgcacaaccgtacagagcagccttgttttttggcacatagtaggcacccagttaaatgtttgttgaatgaatgatctttagttttccagaaccatctcacaatttaactcctcttgagtggtggcattcagaactgaacaaaccagtctgtgaaggtcagggtcctattaggcagggtctgatcagtactggggccaccacaaggttctagaaccactcttgtttgttcctcgatggcaatacctaccactctaagaccaagaatgtgcatatgcccaaccttctcctgcatataactttgccttccccatcatctccatttgggcaatttgtttttcctcccagtgtgaagaaactcctctttccttctctctggccccatcccgatgtatcaagacctctttgtcctctggtcatttcttccatggtgtcggtgtcagtgtcattgccaggaacttcgagccagtctgtgcctgtcggtctaggtcactaatgaatcattaggttcctaatgaagtgctgagccctccaggatgctgtatgtcatggttctgttttggttggttttggtttttttggttggtccttccttggagggcagtgggacaactgcctggggctgctgttacctgtgctccttcccaagtgggttgcagattatccctaggatgtgtgggtgctgtggccaggtgcccaggatgggagttctgactcttggacgcagcctccctgtgagcggccctgaactggagcagggctcttaagtacacccggaggtcatttccttcccacccaaaccacttgtaaagtctgcctgccttttttaaaatttatttttttgggtcacgctggtattaccctgggttttagccagcttgataaatagaggaagttgggtggcttcccagcctccctgatgtcatggtttggggcaatctgcaactgtgggaggtttcatgaatcctagcaagtggtgagtttgctgttcttctctgcgaaatttctctgttccgtgccatgtcttacataagttgatatggttccttttgtgacttgccctttcccttcaatgatgtaagaaccccaaacattggtagtcactatgttttgtcactgaagcgctggtgctcatcagatcctcattcctgttccgcttctctaggagataaaggctggtgggtgtgtggtggccacaggggcaaggagggatctgtggactgaaggatgggcctttctttaatgaagttgaggccttggtattcatcaggcatttttgcatcattgcttttgccattattttccacaacttgctgaagtgagttcctgctccctggctgggaagctggtttcttggccctgaaaccagaagtctttgtgttcccagttgggcctttctaactgaggtagagcaggcgaaggggagatgacgttgagctgagcaagtgatggctttccgtcccattccccacccactgagcttgatggaggagctctgttcagccctccttctgcttttcttcactagaagaaatctacttaattgtgtaagtactatgtaaagacatgcctgtggtctatggagtagcaatttggcttcatcctttccctcatcacactcctgggttactggtgggtttccttccaggctattttgtatgcatccacccttgtcactgtattaataaggataggccatgtgcagtggctcacatatgtaatctcagcactttgggtggtcaaggcgggaggattgcttgagtccaggagtttgagaccagcctgggcaacatggtgagaccccatctctacaaaaaactaacaaattagccgagcatggttgcacgtgactgtagtcttagctacccaggagactgaggtgggaggatcacttgaacccaggagtgggaggctgcagtgagctgtgatcgagccactgcacttcagcctgggcgacaaggcaagaccccatttctaattaaaaaataagcatacacatataactttgattgcatcttaacaagtcctcgtatatatattattcagaaacttggttttttctcttgccttatatgcattgacagtctctgtatgttaatacacctaaatgaacttcacttttaagtgttgcataatattccaaaacacagatgtgccattgtttaactcttcatctactaatggaaacttaggctccccccaccacacacacagctgcaatgacagtatttgtgtgtatatttttgtatctatgggtcagtatttctgtggggacaatctctggaattcaaatttctgtatcaaaaagcatgcacatttaaaattttaaaacatagctaaattactctctcaaagtttatgtttccaccaatggtgtatgcaggtgtttatttccccacatgctctccagctttggatattactaggcttttcaattttttcatccactgggaaaaacaaatgtcatgttgcttgccctacttttctacctgtaagtattccaagggagcgaacagagcctcctgttgttcattaataaactggattcccaagaaccattaagtgtgctttattatggtcatcagtaaggttttggaagaggtagtgtgcttgggttgggaaatttcatcaaaatatcagaaatccctatgtggaaaattctcattttcacaaatgttaaatgaacttctttcgatactcaagtcacaatagatttctttctttctttgattattgaaatgtttttcagttgttaatcctacatttagtccacattcagcattgggacatgtgttcgcaattgttcatcgtaggacaggacaacatggttggccttcatttttgtcttttatttcaagttctggggtacatgtgcaggatgtgcaggtttgttacacaggtaaatgtgtgccatggtgatttgctatacctatcaacccatcacctaggtattaagcccagcatgcattagctattcttcctgattctctacccaccccctccccgacaggccccagtgtatgttgttcccctccatgtgtctgtgtgttcacatggacacacttataagtgtgtcaccttccacttataagtgagaatatgtggtgtttggttttctgttcctgcattagtttgctgaagataatggcttccagctccatccatgtccctgcaaaggacatgatctcattcctttttatggctgcatagtcttccatggtgtatatgtgccacattttctttatccagtctatcattgatgggcatttaggttgattccatgtctttgctattgtgaatagtgctgcaatgaacatatgtgtgcatgtatctttataataaaatgatttctattcctttgggtatatacccagtaatgggattgctgggcactgaactgctattataacagtctgtcagtaggtcagttggttccaggatgaccttagagatcgtttcttatcacagatcttcatttgaaagtcattatgtcctatttcacatgagaagatgccattacgtgaagtgactgtcatcttcaagctaatagctggaccaatgttttggttcagaagtaaggcatgttggaatattctaaaagatacaagtcaggtcgtcagcaatgctctctgccttgggtggataccccattctttccccagcgtgcatctgagttttccctcatatcattgcaaatacccccatgttcccctttcaactctgagccaaacttagtaattaaccaagagttagccctttagtggagaaacaattctgcctctggcacaagagacctaaatgccccaatccttgatatcaaggagtttaggttctagggaagtgaagtcacaaacacatgaagaaatgtctaaccaagcagggtctctagaagggaccaccccaccccaggtctggtccaatcacttcgttgtccagtgccctatgatgttgttaatgaagtcttcaactgaacagtaattcatgccacaaaaacattaacaaggctgggtgtggtggctcacacctataatcccagcactttgggaggctgaggtgggcagatcacctgaagtcaggagtttgagaccagcctggccaacatggtgaaaccctgtctctactgaaaatacaaaaaaaaaaaaaaaaaaaaattagccgggtgtggtagcgtgtgcctgtaataccagctgctcaggaggctgaggccagagaattgcttgaacctgggaggtagaggctgcagtgagccgagatcatgccactgcactccagcctgggtgacagagtgagactccgtctcaaaacaaaacaaaacaaaacaaaacacattaacaagatcagtccccaaactggctttgggcttgtgcttccagtttatatataagttcctcagcagcagggtttacatccattttttctgtaactccactgccaagttcaagctgtgacgtgcagtagggagcccagggggcgtcggctgatgagctcactgcagtattgaagtattatgctgtcaagaaagtccactttccattggtctaattttgctttttattttttatttttcattttcaggtgtgcacagaggttctccactttgttttctgaactcgcggtcaggtgagtaatgctatttctatgagataatgttgtagaaatgaggaacatgttagcttgggtttttttttctttcctattttccctccttcattgcaaattcccatccccataccaactttattcttttttgtttgttttgttttgtttttaactcctcactcccacttggagctctcttttcttcagatactttcttttccttggggattctattgttgacctgtttcttcttgctaacccaattgcttttgaatgggcgttcagaaatgggtaccgattttgaagttacatggtgcggtcaaagctggggaaagagaatgatcatttacgtggaattatttgggattctgtttcactgttttcccctttcctgctccctggacgtgtgtcccttggctctaacagcttttgtcatgttttgtaatggaccaaggaagtgtttgttctctctctgacctaagtgctgtgcaaatgcagctgtcaaaggatccttccaaccagatttctgcccatgaccctcttctagatagaaattctgaagccgctactttcacgcttcctatttctttcttttttcttttcttttctttctttctttcttttctttttttttttttttttttttttttgagacagggtctccctctgtcacccaggtaggagcgcagtggcgcagtcacagctcactgcagttttgacctcccaggctcaagtgatcctcccacctcagcctcctgagtaactgggaccacaggtgcatgcaaccatgcctggctaattttttattttttgtagagacgggatctccctatgctgccagacgggtctcaaactcctggcctcaatccatcctcctgcttcagcctcccaaagtgctgggattacaggcctgagccactgtacccagcctatttcttttgagactcataaatagtggtatttctgggaattcattgacataaattatcaaaattttgtaaacaatgtaaatgtctatcataatgaatacaaattagaatgatcccattataacttacatgataaataacacattgttattataatagatactagtaagttattgctataaataaggttataacagctgagcagggtcacacagccagtaaatggcccagctgggacctgaagcaggaattggcatggtgtgatgacaaaaccaaggaagggcacagaatcctggcgaggggtgggccctggtgggtgaggcggggttggtttcctgagtccctcacttcctctccagcatggtttcctagatgaccgccaaccatgtgcttttgccctatccctgccccagccctgcagtgcagatcaatgccccaggaggcttttaagaagagcctcttatttctctcctctacatattgatagaattattttgcagcagtagattctggaccaaatcaatgaaaaaatctttgtcgagtgcctgctgtgggtgtgggggtgaggtggagatcaagcctatataggagaggctattgtgttctgcttccttgtttttgtttttaggcaaagtcgagtctgatggaccatgaagagaaagtatcttttgtttgttgttttaaaaaaaatcactattgatttggccatgccaatgaccaatgaatctgagtagtggctattaagctatcgagggcaggaaagatatctgccttgttttttgtggtatctcaagtccctggcatagaatcttgcttgtaatagaacttcaataaacattcgtcaactagatgaatgaatgtcaattattttggaaataattccaaaatctgtttacagtttgtactggagtgtattataaacttatcttctttagctgagtatggtggcgtgtgcctatagtcccagctactcaggagcctgaggcaggaggatcgcttgagcctgggaggtggaggttgcagcaagccgagattgtaccactgcactccagcctgggtgacagagcaagaccctgtcacaaaaaaacaagcaaacaacagcaacaaccaaaaaacaataaaagaaacccaaaaacttgtcttctaattatgcttgtaatcatagctaacacttcttgactacactaagactttcattacattacctcatttaatccccacagaaccctgtgaaataggtcttagcattacttccacgtcttcagatgaagaatttaaactccagagaggttaaggaacagcccaagtttacactataagtggtggagcttagatgtgaaggcagacagatggctctaccatgcatgctcccgaatcctatgctattctgctcattattgtgtgttaaacatactgcaagcattgggggcagaccctgaagaatgaggggagagagatgaagtaggctttcaccttgcgttggataattcacacatggctaatcaagagtatggtagatcgcaggtatgagagagtggagaaatctggagatgagcaagggagccaaaaaacagaacacccctcagccgggcgcggtggctcacgtctagaatcccagcactttgggaggccgaggcgggtgggtcatctgaggtcaggagttcgagaccagcctggccaactgggtgaaaccctgtctctactaaaaatacaaaaattagccaggtgtggtggcaggcgcctgtaatcccagctactcaggaggctgaggcagaagaattgcttgaaccgggaggtggaggttgcggtgagccgagatcacgccattgcattccagcctgggtgacaagagcaaaactccgtctcaaaaaaaaaaaaacaaaaaccaaaccagacaaaaagcagaacacccctcaccaggtttggtgagtgtatgtttacattaagcgcacaatttagttctaatcttgcacgtctgatattgattcacttgttttattgaataaagcttcctttttctgcatcagaaagcacttaccgcttattaagaaaatcatttttgcactgtaaagaccaaatcatttccttccatttgattctagagatgtgtaagtttcacactgcaatgatgccatatggctcagcattggctttactttgtgctctgacaaacaacatacaaggctgctgttttagagttcctattcagcacttaccagttaacctagtttctgtcatctttaggacatggttgtttttggcatatgggatgttgtttctcttactacggtaatactggctttagttcttggtgaccttatcttcaaaaaattttgttgctgaagttcagaatagttccttttgtccaatatttattcaaactacctcaatttacaagatttgaaattgcttctagacatttctgtgagcattttggagaaatctgaaaacagtctcatttgatttatataatgggcaaaaatctaaggactttccttgtctggttttggcatcggggttatgatagccttgtaaaagtgagttcagatgtgctctttttcttgagtttctgtgcgattgaaactcttattccttaaatatttgatagaatcatcagtgaagccatctgggcctggagttttctttgtgggacaagttttgagacttttaatggttatacctactattcatgtttaccatttccacttgattccttcttggtaattggtatttttttctagaaatttgtccctttctatctagagtttcaaaattattgaagacagtttttgctaagagccttttatatttattatgtttatagcatttacaggtgtgttgctttttccgtacctcttattagctacttcctcactccctgcctctctctttttctcccctttttccctcccctccctctgtctcttgattttgccagaattgtcttttcaaagagcaacgttggctttgttaatctttatgtcttttttctgtttttattatatgcttttttttttattaccttccttcttcttctttgggtttattttgctgtactttttcacacttcttaagaaccttaattcattaattttaagcctttctctttttctaatttgtatgtttaaaatataattttcactctatctttagctgtatcctatgtgttttatatacagtgtttttcttattgatcaagtcgaatattttcttttttcttttatcttttttgtttttgagacaaggtcttgctctgttgcccaggctgcagtgcattggcgtgatcatggttcactacagcctctacctccttgcctcaagcgatcctcttgcctcagactcccatgcagctgggaccataggcgcataccaccatgcccggctaatttttttatttttttgtagagatggagggggggtcccactttgttgcccaggctgggctcgaactcctgggctcaggtaacccttctgccttggcctcccaaagtgctgggattacaggtgtgagccaccacgcctggcgaatattttctaataaacattgtgacttctttgacccatgggttatttgttaaataacacatctaactttttgttattacaccttaattgtgttgtggtcaaagaacatgctgcttttctgttttccaattgtttaaaaagcttttgagacttttctgttggtctggatggttttcacagacattccatgtgctcttgaaaagattatgcgcgctgcagttgttgaatgggggcttctagatatggtcctcatgttgttggttaaatgtgtgattcaaatattctatatccttaatgactttcttatttaatttttaccaattgctgatagagatctctcattatgattgtggatttgttctatttctccttatattctgtcaatgctgtttggtgtattttgaggctatagtagttgcattcacatgtaaatttcttcagtcttcaattcagaattgaatcttttatgaatgaacggttttatttctaggtaaagtattttgctttaaagtataatttgtctgatattagtataaacacattaattttcttttgattagtgtgggcatagcatatcttttccatctctttactttcaaactttctgaatcattaggttctatttgtgtccttgtaaatagcatataattggagtttgtatttttttcagtctgataatctttgccttttaatggaatcattgagtccatttatatttcatgaatcattgatctgcttttttttttttttttttgaaatagagtttcactcttgttgcccaggctggagtgtagtggcgcaatctcggctcactgcaacctctgcctcctgggttctagcgattctcctgcctcagcctcccaagtagcctgggattacaggcacctgacaccatacctggctaatttttttttttttttttttttttttttttagtagagacagagtttcatcatgttgatcaggctggtctcaaattcctgacctcaggtgatccacccgcttcggcctcccgaagtgttgggattacaggcgtgagccactgcaccggcctgcatttgtttttaaatctttattactttctatttttcctaaccattctttgttgctgtttctcctctttcttgccttttttcagactgactgaatatgttagaaactgttttcctcctccactagttaggaagttatatgtcccatttctgttgtttagttactaaagatattacaacctgttgtagaaattacaacatgtctactcaacttttcaatgtgtaaagataatcaatacctttagcttcctctagtataatccaaggaccttgaaagactttaatttttgaatttcattttgtcatctccttacttatattacatataatgcatatattgtctcctatgtttatatatatgaggtagttgccatatgtttttattttatcatgtttcactaatccctacaagatgttattgttttatatagtagttttgttttgtttcaagacacagtctccttctatcacccaggctggagtccagtggcacgatcttggctcactgcaacctccacctcccgggttcaagcaattctcctgcctcagcctcccaagaagctagggttacaggtgccagccaccacatctggctaatttttgtatttttagtaaagatggggtttcaccatgttggccaggctggtcttgaactcctgacctcaagtgatctgcccatctcggcctcccaaagtgctgggattacaggcgtgagccaccatgactggcactgttttatatagtaaaagttcatttggatttgccagtagagagtactacccctagttctgggcacctggggcctctggcctgtgacttgtgatttagagtcccctctctggcccttctctagctccacccttctccaaatggcaagaagtctgtggcaccaagaagtcatgcctacccggagctacctccctcttcccctcacccttgcttctagatcgtactctgggaatccgggaccctggaattcccaatccaaacattctgtgccaatttccaggacctgggcactccccttcctcattgcaagccatgctgcaggtgtacgtacccccagacccaagggatgaccaaggggtacatgcatgcaggagagggggttaggggtatgcaggctgtggtgatcacatgagtgtgcacaaagcctcttacagcttggaatgaagccttaggggaagaataagggcaaagccttcttttaaactcttgatctgtatcttagaaatgttagccatgggcctggccacaaacccaccactttctttgttcctcattcctcctttcatctcagttcttatgtcttttgcctaaatacatgttttaggattgatttcagtaatgatttgcaggtagggaacaacatcacagtttctgtttgtctgaaaatatcttcatcttgccctcattcttcaaagatattttccctgagagcagaattctaagttggcagtttgtttctggcacactgcagatagacttccactggttctggcttccattgttgcttctgagaagatagctgtcagtctaacagcagcttcttaacagcctttttctttctttctttcttttttttttttttttttttttgaggcgaagtcttgctctgttgcccaggctggagtgcagtagtgtgatctcagctcactgcaacctctgcctcccaggttcaagcgattctcctgcctcagcctccagagttgctgggattacaggtgggcgccaccacacctggctaatctatatatttttggtagagacgggggttccgcctcgttaggcaggctgacctcgaactcctggcctcaagtgatccatccgcctcggcctcccaaagtgctgggattacaggcatgagccactgcatgcccagcctaacagctgctcctttgaaggttatctgtcttgtatttctgacaatttttcagatgttcctgtttttgtttttgtttttttttttcattttcactatgatgtatctaggtgtagatctctttttatttcttttgattgagattctttgggctccttaaatctgaggattggtgtttttcacccatttggagacacttagtcattatcattccaaacactgattctctctttgaattttgtttaaatgtatgttagacattgtatttcttttctccatgtctctgaacttttctttcatatgtcatatttgaaactcaggtttgcctcattaggcccatacccacaggtataagtgggcttcattgcttacattacttacctgggttcctgcttgagtttcacctttggcctggcaattcctttctatctggccagctctttgatatgtttaagaaaatgcgcagctgggcatggtggctcacgcctataatcccagcactttgggaggccgagccgggtggatcaactgaggtcaggagttcgagactagcctggccaacatggtgaaaccccatctctactaaaaatagaaaaaattagccgggtgtggtggcaggcgcctgtaatcctagctactcaggaggctgagacaggagaatcgcttgaacctgggaggcggaggttgcagtgagccgagatcatgccactgctctccagcttgggagacagagcgagactccgcctcaaacaaacaaaaaaaaaaaaaaaaagaagaagaagaagaagaaagaaaatgcgctgggtgcggtggctcactcctgtaatcccagcactttgggaggctgaggcccaggagtttgagaccaggagttcaataccagcctaggcaacatggtaaaacttcatctctacaaaaaataaaaaaattagccaggcatggtggtacatgcctgtagtctcagctactcaggaggctgaggcaggaggatcaattgagcccacgaggttgaggctgcagtgaaccgtggtcatgccactgcactccagcctgggtgacagaatgagaccctgtctcaaaaaataaataattaataataataagaaaatgcttttagcattttattcatgatttttaattgtcttcagcccaaggtttgatctaactaacctaacccaacatattcccggaacactgaagacattttttttttccctgagatatttcctgtatcgaagtcattgagcagtgttcaaatagaaatttaattatgcttttcttaccagtttcctgattctttttctgacttctttgagaattgaacaatccaaatcaactgctttttcactttttgttctcactttatccacactgagaacccctgcagtccttctctttttacatttccccttgtggtggtcttgtaagccaacatatatgactccgtataaatgtctcaaaagcatagagttttctagaagacttagggaacaattatcatacctcttataactcaggtcagaaatattgatcattgtctatatcatagtggctatggtataatcaaagtatgccagttaaccagagataacagagaataaccctcacacagacctgccctatggtggtatcaagctatttctccctttctaatattattctttgattattctatatctaaagacagatttatcatttattggcataacaggttgcactgatgatatatatttcaaaaatatgatactgatactatttaatgaaattgaagagctctagaacgagtttttagagtggaagcaccacggcatatagtcatgtagttcgtgcactgtacaactctagagggaggttgccatttacatcagagttcacaacctaaaagggggccctggataaagatgaattggggatcatctttaatctagtgtcaaggtctacgtttcactgtttaaatgctaccaaatagttttctctgtaattgttgctatcttcctagccatccttagcaccttaaaaatttactaagaaccagtggctgttcagatcctctttgttgatgacctggatagcattgagctaacccagattgcaccagaagatgaatagatgtttgtgttaggctgttcttgcattgctgtaaagaaatccctgagactgggtcatttataagaaaaggggtttaattagctcctggttctgcacgctgtgcaagaagcatagtggcatttgcttctggggctcacttatcaccaaggggatggcccaagctattcatgaaggatcctccatgatccaacacctcccaccagctcacacctccaacattcaacatgagatttggatggggacacgtatccaaactatatcaatgttccagctgaaaaagagaaaaatggctttgatgtgcaatgactaaaggtttcaaacttcacagattgccctttgattagtgatcctagagactttatgacctaataggacattctcggtttatgcagaaggcagtaggagctacattatttcaaataccataaaacttctccaaaaacatatgttcagccttgaggaaacgtattccagatctgacaactgaaagcagtctgcattaagttcttgatctatatatttttttcaagatgattgctggggtcatctttcattctggcctttcctacctgcatttggaagttgagtagatcctgcctgtagtgaaaaggcatagtttattttgatcagaggtctcagttacagcacatagtagtcactcactgtgtatgtacactgagtcactgagtacacgaatttgcctttgatcatatcttgtacaccacttaggtcctgccctacgagttagcaaagctcaagaatgagtctttagacattcttaaattgtataataacattttgaacttgatgtctttcacctgatggactcaaaacattttacttacaaggagacaaagtctcaggaggctggcattgtgttctggtagaaagagtaagggttctgccaaatagctgaatgaccttgacccatcccctagacttgcaggggtgtccaatcttttggcttctctgggccacattggtagaagaattgtcatgggccgcacataaaatacactaacactattgatagctgatgagttaaaaaaaaaaaattgcaaaaaaactcataatgttttaaggaagtttacgaatttgtattgggccacattcaaaaccatcctgggccacatgtgacccgggggccagggttggacaagcttgcaatgatgggacctctttcatctgtagaacgagggttcgaggataggtgatttctgagttcctttccagaaataaaccactctgatactctctccccaggctacacttaaatacttgtgaattaaatctaagtcaactccaccagtttcaggtacagtcaagcctatttgtagaggagagcattttctgtggcactgaagttcactcaataatgccttcattttttttttttaaagcagtgcttttggaggggggacagagttcaaaaactttaaaaaatgttaatttttaaactttttattgaaacttatggcatacatatatgtgtacaactcagtgaatttcgtgaactgaacacacccatgtaattggcacacagaatattctcggtacctcagaagcctcccttgtgcccacatccaatattgttataactccctccctttcaaggataacccttctcctgacttctcaccacatcaattagttttttctgcttcggtttctcatgaatggaattatgtacaataagcactcttttgtctctggtttccttggcaaacattatatttctgagctgcactgagattgttttgtgtagctgtagcagacacttagatctttcctccagagagacatcgatacatctttgcacaactgtgttaacatcctcatttgagtgactcctttgggaagatcaataacatgccattatgcccagagagaggttaaaagaggagggagaaattagaggctttttataattgattaacatattctagcattaatacataatacaatttattaatttaagatatgcaagccctcttctgaaggagaaagattcacctcctggtctaaaacatcatcatgtcaggtcaaggaaagaatcactctcctagtgctggttatgagtattcaattacagaattcttaaagattgccagctttaccttgagacagaaactctgacttataaaacccctttctttccatgccctccaccccttaatcccagcactgcctgatcctgcacatactaggtgcaaaatagatatttgttgaatgaatgaatgaatgaatgaatgaatgaagagcacagctaacatttacagtgcattcacagtgccagccactgtgcaaagatttcttgtttactcaccgcaacagcactatcaggtgggtgctgttgtctcagtttgctagatggggaaacatgaccattggaaataacttgtccacagtcactcagatattatggggccaagttgggacctttgaactcatgctctttagtcttcaccactgtgtattcacactcactctagggcttgcagaagctgcaagtggtggctggattcatgagtgcccttggccgagagctctgctagctgaggacacacagcctggtttgtcccagccacttccctctggctgtgtagagggagcctgcccagttggctctcgccacccccttgcttgtgcctgtgcccatgagtgattcctttctcagcaccccacgccagcctctgctcctagtgctgactgcccatcttggggtaatgttggccaactcccagacatgagaggatcagacacagtcttagcatttgcaattctttctgtgtgctgaactctcccctagcccctgccccacctccagcacgtgcatttcatctagttcactcctattcagccctcacatctcatctggtacatattggccctcaataaatatttgttgaatgaataaatgaatgaatggtaaatgaggcttttaaattcaattctgatataaactactgaaatgcaagcaatgatgataaaataatatgcaacaaaaaggaaatgcaatgtactgatgaaactggatagttcccttgacccctctgtgggattcatgaaggagtggctcgcttactcagcccacagctctcaacccctcgtgggagggggagcacgcaggtgagtgggtacagaggccaggttgagtgcttctgggcaaccagcaggagcaggactctgtgcaggcccacagcagcgtctacaggttgcccgcgacccccgagccccagagggcatgtgttaccgcgcattcttttagcattgccatccttggacagtgtaagtgttaaacagttcagtggagggtcagtgtgacagcctcttgcacctgcaccaaggtctttgtctggcatccaggagtaatgaagttgtaagaacaaattggagggtggtgaatgcagaggattttattgctgatgaaagtggctctcagtgggatgggtggctggaaaggggatggagtgggaaggtggtcttcccctggagttcggccatctgcggctgaactcctccgaagtcgcactgtcaagccatccctctgaagtcaagctgctcctctccaaggtccggctacttctcttctctcctctgccactctgccagtggggcctgggatttttatgggtacaggatttgggggcagggcaggccagggtggttttggaaaaggcaacattcgggcagggaaatgagaatgcatgttctcacttttggctgcgggtccaggcttgagggtgtggcccttgtctagggccacactcttctacccaatatttccctgcctcctgtccatatcacttatccttttacagtataaaacatacaagagcgaaactccgtctcaaaaaaaacaaaaaacaaacaaaaaaaacatgaataggagctgggcacagtggtgctgcctgaggcaggaggattgcttgaagccacagtatactatgatcgcacctgtgaacagccattgcactccagcctgggctacatagcgagaccctatctctttaaaaaaaaatttttttaaggaaaaatgacatagagaaggataattattgaaaagattctgtgtaatggtaataatgatgtaacattttgtgttttttattccttctcttgttattttgcatgtgttgatgttttccataaatccacatggactaccttgcttctaagtataacatcctactgggcaaccctcccataataaacatgggttttgcttgttgtcaccagtgcccaactggcgtttctgattctctggaaccatagcaatttgaagtgcacaggatcacaggttgccttggttgaggaatgacctttgaggtattgctgtgttgtgattatggcagctgtgatgatctgtcttctccttactttattccaggatggttttctctgtcaggcagtgtggccatgttggcagaactgaagaagttttactgacgttcaagatattccttgtcatcatttgtcttcatgtcgttctggtaacatccctggaaggtaatgtgtctgtttttcttcattttttttttttctgtttatctgcatgtgtgtatttttttgttatttaggatttttttactgtggtaaaataacataatatttatcattttaaccatttttaagtgtacagttcattggcattaagtacattcacaattttgtgtaactgtcactgctatccatttctaaaacgttttcatcatcccaaatagaaactctatatccattaaacaataactcccaatttccttcccccccaccccttcctggtaacctctgttcctgttctttctatgtatttgcttattgcaagtaccttagataagtggaatcatacaatatttgtccttttgtgcctggcttatttcacttaggatgttttcaaggttcacccatgttgcagcatgtatcagaatttcattctttttaacagctaatgtttcactgtatgcattgacccattttgtctattcattcatccattgatgggcatttgggtcgtctcccccttttggctgttgtgaataatgctgctatgaacatgggtgtacaaatcactatttgagtccctgctttcatttctttggggtatatacctaggagggaattgctggatcatataaccctgtgttgaacatcttgagaaactgctaaactgttttccacagtggctatatccttttacatttctacaagcaaggcacaagaattccagtgtctcccattcttgacaatgcttgtattttcctgttgttttggtaatgggtgtgaagtggtatcttattgtggctttgatttgcattttcttaatgattagtgatattgagcatcttttcatgtgcttattggccacttgtatatcttctttggagaagtgtctattcaagtcctttgctcagttttgaattgggttgtttttgttggtgttgagttttgaagttctttgtgtattctggatattaatcccttatcagatatataacttacaaatattttctcccattctgtggggtgtttcttccactttcttaatagtatcatttcatgcataaattcttttaattttatgtagtctatttatttttacttttgttgtctatgctttggtgttatatcaaagaaatcattgccaaatccaatatcatgaagactttcccctatgttttcttccaagaattttatagttttagctcttatgtttaggtcctttgatcgatttatcatttttgtatatggtataaggtaacggtccaacttcactctcgtgcatgtgggtattgttttccagccacatttcttgaaaagactgcctttttgctattgaatggtcttggcaactttgtcaaaaatcactttgttataccagtggagggtgtctaggtttttggcatcttgaacaaataattggacaaaacgcactaacaaagcaaggaaggaatgaagagatttattgaaaatgaaagtacactccacagtgtgggagtggcccgagcacaggggctcaaagtccctgttacagaatttgtgggagtttccattggttacttggtgtatgccctatgtaaatgaagaggatgaagtaaagttacaaagtcatttactcagcatacaccctatggtgaggatatttcctgtcatagctgaagtgtgaatcggccttatgttccctgcctccagaccctattttcctgcctcaaagtgaccgtatagatgagggtttatttctggtgtttacttgtttttaaatgtatctacttgaaggtacaaccatatggaaatttaaaggtggtagagaatcagacagatgaagcagcctggtattttcggaaagggggatctttagaagttcatggaacaagaagaaaaggcatctgagaaaagcagttgaaagaccagcaatgctgggcctgcaatttctgtgggcacaactgccaaaggcaagtgtaaagaatcctcattaggaggttcacacctgtaatcccagcactttgggaggctgaggagggaggatcatttgaacccaggaattcaagacaagcctgagcaacatagtgagaccccgtctctacaaaaatgaaataacatgaaaaattagccgggcatggttgcgggtgtctgtattcctagctactcaggaggctgagatgggaggattgcttgagcccaggaggcggaggttgcagtaaacagtgaccataccagtgcagtccagcttgggtggcagagtacaaccctgcctcaaaaaaaaaaaaaaaaaaaaaaaaaaaagaagcatcctcattaggaatgggactaggaaatgattgatacttaagacatcaaggacacacaacgaaataactttcttattcagaagtgggtggcaggaccaaggaatctttattgcataagataaaaatctactagcagcaaacaacaaaacatacaaacaaataaaacacacatacaaatacacagactaaatggaaaacttcccaacaagctataacacaattggcaatcctttaaaaagtaggtactggggcacgttgtcaaaaagccgccattctttaaagaaagaaataatggccgggtgcagtggctcatgcctgtaatcccagcactttgggaggccgaggcgggtggatcacctgaggtcaggagtttgagaccagcctggccaacatggcaaagtcctgtctctactaaaaatgcaaaaaattagccgggcgtggtggtgcacgcctataatcccagctacttgggaggctgaggcaggagaattgtttgaacccgggagcagaggttgcaatgagctgagatcatgccattgcactccagcctgggtgacagagcgagactctcaaacaaaaaataaaataaaatctaaactattctcacacgcaccatctccttagggcactgaaacattactgtgggcttggcagggcaaaactcaagagtccccactttactgatgagtaaatgtccccagggaggttattggttaggaagtggcggagtccagattagatgctagatcttcagtctcacgtttcggtgctttttccaccacaggggtagatgaggcaggaaagtggaacacaagggaaaaaattcatccaaatgaaagctgtttgttagaaatatgtctttttgaaaaattatgttttaaaatgccaacaacaggggcaggtaaataggaaagtgcatggctctgaaacaaacctaagtagggaaaagctgagtgatcactcaaggcagctgactgcatttcttgctccagatctctgatgaattgatttcttaaagcagtggttcccaaagtgtgacagacaagtagcactggcatcacctgtctctcagaacgcccagtaagagtatttattcatgttatttatttattttgtttttgtttttgtttttttctttttctttcttttctttacttttttttttttttttttttttttgagacaggatcttgttgtcgcccagacttgagtgcgcgatctcagctcactgcagtctcaacctcccgggctcaggtgttccttccacctcagtctctggagtagctgggactgcaggtgacatcaccacgcccaactaattttttaaattttttgtagagatggggtctcgctatattgcccagggtggtctcgaattcctgggctcaagtgatgctcccaccttgcttcccaaagttctgggattacagatgtgagccaccacgccctgctcatgttactgaataatcaccttgatagcactcaccatgtgccagccactgttctaagcccttacaaatggctaattcatttaaagcccactctataaccccttgaaaaaggcactattatcagcttattttacaggtgaggaaattgaggcacagaggagttaagcaacttgccttcggtcaaataattaagaggttgcagagttacaattcaaattcaggccatctggctccaaagcttgtatgttggacctctatactatggtgccttttcacattcttaacctctctgctatgctaggctcagttgcttggtagttgtgaatctgtagattaaaaataaagatggaatccataattgtgagaatcaatgttgttctggatcacccaggtggttcataggcaccgcctcctccaatagctttggactggggcaggggttcttttagttcaggatggctcaggcctggtttttgaaggccaaggggactgacctgccacttctccactgggttatcaattgtgcgataatgattgcctgctgtgtgcccagcagtactggctgctgagaacatcgtctctgactccagggaattcacactgcagttggagggccgtgactatgacgcatgagaacaatacaaactataagtcttaaagtatgagtcagcgctatagggcactcacatatggcctgtggccagatctgtggattagtctaattcgatgctaagccacctatagcagatgctattggtgccctgcctatacccccttggcccaccccaggggtcacctgcagacagttcctgtggatgcttacggctttcatgtctccctgaggatcatctatgtccatgggagtgtgcttggcccatgtgcgggacaaaccagaagtgccagggagataacacccccaaacagtgagtaatgggagttggtatttaaatatgccagcttccttgtcccttggtgggaccacactcagatgtgttctatgttatctcccagagttccccagttgcattgtaccccataatactcatctgctcatgaatgtgcccatttccggattcacccccttgtctgtctcacttgcatattcccccactctgcttctggggaccctccctattgggaaactccccttccaaagttgaggccaaatcttactacctctagaaaacctgccctgacctcggaagaattaaatccccctccccagtgcttgcttctctttatccatccatacctggggatatcactttgtgtcacactcattacgggcttcctttgtactgtgagtccttgcagtgtgcggtcagtgccagacaaaaggttggcgaggcgggtggcgaactcacgggagggaagctgatgggcactgagagcctgctcagggccactcttccaggtgctttacgcacattatctcatttaatccttacaaaacctctttccggtgggtagttttcatctcggtttacagacaaagaaactgtcaaacaaatgaaggcatttgcctagaggtcccacagctaggaagattccccatcagaatctgtagcctgtactactcacacgacaccaggctgcccagggcaccctcagtaagtgtctggggactgaatgagcatgtcactgaggtgcagggctaggggagtggagagggagcctggggtgagctgttagagagcagcagctcccccgacccggggctctgggagatctggaccgtaaacacagtagcttcaccctggaagcctgagaggtgactcagtagctcttgacggcagggagaggtgggatgacactctctcgtcaggccactagccaacagagagagcccgtggaccttaacactttcagttgtgtgatttggtgacatttgaggggctcattcttggtctaccagaatgggttttggcacctccagcctccagctctcctgggcggtaccaatgcctttttttttttttttaaatctttgaaggaggtcttcttttagatacaactattctattttccagaggggcagatgacataatagtggaagatggttataatttcattcttgcagagttgtcttcctcatttggaaacaattacacatttgagccagtttggtgatctcatgagctacaatccccaactttctctctgggctgggtctagatctttctgtgctgcaggcatttccagcgatgagtccctctataattcccctctctgaggcctggctgtctgatttcctcctatcctctcttgctgtgttcacctgagtccttggtcttccttgcgaggaagtcggtagagctgcaggaaatgggctgcgtgctcctgagaggcgggaaacctgttctgtttcattttgtcctctaataccagaccctgtcctggtctcctcattctctctcaatcccctgtctgtacaaatgaggttataaatgcttaccatggcactgatctgatgctcagccaatctcacaacccccactgacccctgccaaatcttactacctgcacccaggcatgaggccatgtctgttggaccctggctctttccctagcaggtggaagtggtgatggggagtgatggagagtctatcatagataggttgcaggggaaactgaaagcagagggcattgtgtcccactctccacttggaactccaggtaaggactccttatgggccctgtgtgtcagcacagggcagttgcagagatgaagtggcaaaactgtttcctctgggagatgatgtcccctccaagtctctctcagctctcatgtggtagagtagggactctaaagtaccctcatgttcttagtgggtagctgtgatgagatccaggggtggggacagggctgcaaagactatggcatggacagcctaggccaggggtcagatggaggatgagacagacattcagtggtgagagctcaagggagctgtattagcaggagaaggaccccccaggcctggatgggattctgaagaatagaccatgggcccactggacacagccttcagcagtggacaccagttggatacccaggagccctgcaggatgagggaggtctctggagaggccattgagaactcagggctcagcactgggtgagctcacagatccaggccccttctccctgctgccagaaaggccctagcacgccattctcagcccaggcgccatcttgactaccagaaagaaaaggagggtggacaaagattgtgcatttattcacaagtcattgggttaactagagaccattttagagcaaaagagacaaagctaccttaaatcatcagacttaaggatctctttcctatatttctggagtggaggctctgaaacaaaagggagccaccctagatatcaaaggcagctcaggaatttttggtgtgttttggtgctattgtttctacatctaaattgtatctataaattttaaacttgctttaaaatgaatacatattgaacacagaatgatgtgtcagggcactccattaggaattgtgggaggccatcatcatatcttgaactctgatcctcctccaggttttatcttttcaggtatgtagagacatcattcaggtcctagagggtaatggtgacatcttttctctctttgtagcctccatattttctagcacatagtaagtactcagtaaactgtggttgtctaattggtttcgatttgtgaccctagtctaaagcctagagatattccaaaaagtgggccccccctcagcttacatcagcagtactatgctcatccgaacccagtcagttctgatacagtgtagactactccaaacttctgtatagacttcagtgaggtggctgtaccttggctaggattacccttgaagaatggatttcccctcctccatatgaggaaggagctcaactgattccccgttaagattccttcacagtctgacattctgtgagttcaatcagccagtagggaccatcttcagattcttcattcattgtcctggaataccagggatcctcgaacattatgtcattctggaagtccttgggtgatgtctgagctgctgattatttatgccaggttctcacatttgggtgcacattggaatcacctgggggaatttaagaacacctgcctcggccgggtgtggtggcttacacctgtaaacccagcactttgggaggccgagccacgtggatcatttgaggtcaggagtttgagaccagcctggccaacatggtgaaaccttgtctctactaaaaatacaaaaattagccgagtgtggtggtgggcacctgtaatcctagctattcaggagcctgaggcaggagaattgcttgaacctgggagcagaggttgcagtgagctgagattgcaccactgcactccagtctgggcaacagagcaagactccatctcaaagataaaaaaaaaaaaaaaaaagaatacctgcctcctacccccagagattctgacattattggtctgggggcacagcctggatattggggttcttcaaaataccccaagcgatgctagcagaaccgagaaccactcacctctgcaatcccattttaaggctgttctcctgttcaaagtcctaatgtgaaattggaaacaatttataagtcacattttttcgaactacatttattatgtgaggcaatttcaaaggcttttaaagttataacaaagccagtaatctcttgatttcaaaatggataaaagctctagaagtggctcttgccgactggcaaatcccccaagttatcgttgctgtccttgccttgctcttcattgaagaatcccagtgtctcttcatagtatcttatttatttatttatttatttttctgagacagagtctcgctgtgttgtccaggctggagtgcagtggcgcgatctcggatcactgcaacctccgcctcccggcttcaagcaattctcccacctcagcctcccgagtagctgggattacaggctcgcggcaccacgcctggctaatttttgaatttttagtagagacggggttttgccacgttggccaggctggtctcaaactcttgacctcaggtggtccacctacctcggcctcccaaagtgctgggattacaggcatgagccaccatgcctggccttcttcatagtgcctttagtaccagtactgtgtatactaagacagattctttagtactactacatagtactggtactaaagacagattctttagtactactacatagtactggtactaaagacagattctttagcactactacatagtactggtactaaagacagattctttagtactactacatagtactggtactaaagacagattctttagtactactacatagtactggtactaaagacagattctttagtactacttcatacatagtactggtactaaagattaacaacagcagcagcaacacaactggacactcctgtaggtctttgcggttgacgaagcaccttcgcatacatcatctcacggtgtccccttgaggttagtagaaaagtttgtgttatcctcactttgctgaagagaaaactgaagctcaaagcaatggagtgactttctaggttacccagaaagaaacagtaccaagatccagaaagtgcttatttttggcttggacagtttgggtaatttccaaattcacacagctggaaagtggaggtggtgagattctagaactcgtgttcttaaccacttccccaatatttagtcctgaagcattaaaaatggttttcttgttgttgctgttgttgttttagagcctgggtctcactgtgttgcccaggctggaatgcggtgcctattcacaggcgcaacaatcatggctcactgcagcctcgaactcctgggctcaagccatcctcccatctcgacctcccgagtagctgggattacaggtgcatgccaccgtgcctggcttgaaaatggtttttacacaactttgcatgatttgttcatcctgggatgaatttatatccccaaagcactgtataaagataaagagtgatctaaggcataaaagcaacagttctgctgatttaacctattagggtttaagttgatattccaagagaacacgctgttgaaatgcaccttaatagcattccttagttcaagaaataacaagaaacacattgatcttgccaagaggcctcacatttacaagatcacagggctgtaaaaaacatcaaggtaagttagagatacttttgcaatgatgtttgtgatgtgatgtgtgttagtctttaacatccgtgtccagtgtgacctatacccttttgttacttttcttttagaagtgaacagagcataaagtaaaagttactctaatgttgctatagtatttagtacagcatagagttttttaatttgaagaagagataaacaaagatataaaatggcagtaattttgctttagtgtgtaaattagaattgcttataattatctgattaattgaatgaacaggaattgaacacatagctctgttgtctttcaattatgtagacatttttgccttgctcctaacttgaaatatgatttgatattacacagattgggattcacagtgaagtctaaccaattctgggttttggtgtacacaagcagaaggagatgggtttgaattagtgagaagttttcagttacaggatgttttcaaagtagagttttaaaactttgaagtgagttgcataatatgactagaatgtaaactctctttgaggccagggactttgttttattccctgctataacccccgtgcctggcacacagtaggccttcaaaaatgggattaaaagaataaactttggcaaatgacttcacatttctgagcttgtgtttcctcacttgtggactgaaggggttggactattttggtatctggtattttccccacccatgacctattttgtaattcttttcttccagtgaactccaagccctaaaagatgcttttgcacaatttatttaagtaagattgttctcatttttggtgttgagtaaaaacatatatgacagtatccagtgtttgtgatcagcagtagaaaaccagtattgatataatcccaaacggtacaaacattatactctatttttattttatttttattttttagagacagggtcttgctctgtcaccaggctggaatgcaatggtgcaatcatagctcactgcagtctctaacacctgggctcaagcgcacctcccacctcagcctcccaagtagcttggactataggcatgcaccaccactcccagctaattttaacatgtttagtagcgatgaagtctcttcatgttgcccaggctggtctcaaacccctgggctcaaactcctgggcacctgcctcggcctcccaaagcactgggattacaggcgtgagtcatcgcacccagcctcagcctcacactctaatttttgtgtgtgcagcctattgtggataaataagcgatttttgaaatgatgaaagtaccgtctaaatgactacctttgcaaaacgtacagtattgcactaggtcatcttcaagtctcctttacctctgaagtggatttctatgaacttcagtttcctgatgtgtaatacgaagggatggaaccccatgatctttgtaggaggtgccttcctatgatgatcctaaactatggaaacttgaattagatgagcacagtgttctaacagacattctcactaacctagtgttagtgaataaataagaatgttttatagtcagaatggaaatctcatgcatgtaaatcctggaagaaaccatcttcatgattttttaaaatgccctctacaaattactgataccacattgtttgcattaagtgagaaaagtagtttattatataatggtaaactttatccaagggcacagaatcatatagtctgaattaataataattacaccttattgttgaaactgtgataaaatgcttgataaatgtaatataatttcattcaaagaaatcactcccattttacagataaggaaatacaagcagaggaatgttagaaacttactcaaggcagagccaggatctgaacccaagtcagtctccttaatcacatttaaggcttggctcagcaggcatgttcatttattcattagaaataaatgaacacagacattttattcatatgtaggagattaccaaatcagagttacagattattaaaagtgagggatctcagatcaaactttcaaagctcatgacaagccaaagaaaataggaggagaagacattattagaacaggagctaccaatgtataaaggctggctaaggattttctgaaggttaagggttaacgtggcttcaaaacagaggcaacttaaaaatacaatttttccaactaagtaggatttctatgcagcaggactatgcctaattccaaccctcttaatggttttttactagcatgtagttgtttatagaactagttcctcacataggagtcccactttcaagggtcccggagaaccacgatatgaacattcgctaggagcaaagctgatagggtgagtcataaagaaggggctgttcatattcagcctcaaagtggcaaggacttctcctcctcgggttcatgctgactgcctgacttttgaccttgtcaatatcatgacaaagaacaagagagaaaatggtggctggggagagtgattttagcattaatcttgtcccacccttagtttaatgggcattaattacttcacagcgctcaaattaaatctgatgtggcagagactggctggcaccaaagcttttactttttcttcctcagcacacagctaggctacatttcccaacctcccttgtagttagaagtggccgtgtaactgagtgctggccaatggatgtgggtataagtgatgtgtgccacctccaggcctggtcattaaaaatctcccacctggccaggtgcaatggctcacacctgtaatctcagcactttggaaggtcaaggagggtggatcacctgaggtcaggggttcgagaccagcctggccaacatggtgaaaccctgtctctactaaaaatacaaaacttagccaggcgtggtggtacaagtctgtaatcctggctacttgggagactgaggcaggagaatcacttgaacctgggaggcggaggttgcagtgatccgatattgtgccactgcactccagcctgggtgacagagtgagagagactccatctcaaaaaaaaaaaaaaaaatctcccacctgattcccatcactctctctctttccccgtttgcctgccgcatcgtgctctccagagcaaacttggaatctgcatctgacacatggtgagaactcagtaaatactagtaattatcactatagaccagtgctcatagaacatttttttgcaataacggaagtgctctatatctgtgctgcccaaaacagtggccaccagccacatgtgaccacagtattgagcacttgaaacttgactggggtactaaattctaattatgtttaactttaattaatttaaatttaaatagccacatgtagctaatggctaccatgttggacagcacagttatagaccatttaatctaattgcttcagaaggtttctatctcaaactgtgtaagtcaggattcaatcacaggagaaccactaaggtgcgtgcacgcgcgtgcgcgcgcacacacacacacatacacacacacacacacacacacacacacacaaagggatttgctacagggatttgtcctaatacaactgtgggagctggttaagcagtctctataaagctctcatcttcacatctgatgttgggactcgacatctatcggacaggcagttgggaaggaaggataaatgtaaaataagggagagcaagaacaacctggaaaccagaagcatgcattgtagcccacgagaacagactgagccccacgtcgcttattgttgcttttgaccttggcagtatggatatcctgcagaagctgggcgcttcatcataaagtacacacatggccaaggagccgaagaagctgaaaaggaaaacccaggagaaggtggagcagttacaggccccgcacctccctggtcctaataagatgaggcaactgatcattgccaacctatgtgagctacaacatggctgctgcccacatctgcccagatctcccacaggaaactctcttctgtcccacgttaattagaaacatgcaagaaagggaattttgggaaatgtagttggtctaacgaagatgatgcattatggagccaccacacatgctagcatgctaatgagctcaattttctatctgctaatacttctaaataaaacatgaagctaacatctcccaaggctctgttttgttgtttcagttctgcaactggcctagagaattctgaagatccttgcagccagctaacgttatctttgagtggtaagattaggagtacttttcaagtttttccttatatttttctgtggcttagaattcttcccacataaacccacattatgattgtaatcagaaaaaaattagttactttttagaagccagcctgtgacccctagggagaccatgcatcccacttaagggcaacccaataacatcatgattaactgtgtcttctacattcttcctggaaatttcacctgttcttgactttgtacaagaacttataaaacgtaagttatggtcatcagatttcctgaagccctctgcttctctcctcccatgttctcaaagtgatcccaaggatattttagaaactggaagcaaataatataaggagaaaagaaactggagtggaagtcttgcacgtagaagggagaaatcatttttagataagtcactgggaaagtgaagaatagagagcgcatccttgatatggtttggctgtattcccacccaaatctcatcttgaattgcagctcccataattcttacatgttgtaggagggacccggtgggagataattgaataacgggagcggtttcccccatactgttcttgtggtagcaaataagtttcatgagatctgatgtttttataagagatttccccctttcacttggctctctcttttgcccgctgccatataagacatccctttgctcttccttcctcttccaccatgattgtgaggcctccccagccatgtggaaatgtgagtaaattaaacctctttcctttataaattacccagtcttgggtatgtctttatcagagcgtgaaaacggactaatacagtcattgtattaactactgacttgagcagtatttactgtgtattcttctcaatactttaacagtagtacctatgaagtatgtcctgttacacttatcttcgtgcctgtttttcacctgggaaactgaagtgcagatgggttaagtaagtggtcaaagttacatagttagcaaatggcagagccaggatttggacctaggccgtcctggtctttggagtctaggctcttaacctacctgccacactgccttctttaggggtgcaggacagggtcacgtggactatgggagttcgatagattaactgctggcaggccgattcctgtttcttcctcactcccacatcccagtgaccccccctccgccccgcaaaatcctctcacttttaccttagtaggatctgttgaacctctcttttcatgccagcttcccaagcatgggttcaagtcctcatcgtgtcttgcccaatgtacccctgtagcttactctctggccttcccacttcagatttccttcatttatttcatagttatacaaaaaatattgttctgtgtcaggaacaggggcaagggggaagggagaatggggagttattgtttaataggtatggggttttggtttgggaagatgcagaagttctaaaaagagaaggtggtgatggttgcataaacatgtggacatacttaatgcaaccaaactgtacacttaaaaatggttaagatgaggccgggtgcagtggctcatgcctgtaatcccagcactttgggaggccgaggcaagcggatcacctgaggtcaggagttcgaaactagcctggccaatatggtgaaaccctgtctctactaaaaatacaaaaattagctgagctgagcatggtggtgggcgcctgtaatcccagctactagggaggctgaggcatgagaattgtttgaacctgggaggtgtaggttgcagtgagccgagatcgtgtcactgcactccagccagggcaacagaatgagactccatcttggaaaaaaaaaaggttaagatggtaaattttatgtgttgtatatacatatgtatatatatataaacgtatatatgtgtttatatatagacataaaaacatatgtatatatgtagcatataatttgtggttttatatatataaataatatataataaatataaaaataataattgttctgaaatgtaccttaaaaagcctctactgcatctccttctccacaagataaagcccacatttcttagcatagctttcattacttgatcatctggctcatgtgccatgcaggactgtagcttggccaccatctttttgtgccgatgactttgtgatcaaccactcctctttggcccttctcctggaaagaccccatagaactgagagctatcattcagccttgccgattatcatggaagtagcaggaatgatgggttaataaggagatagacttacagacagcctctcaggtggccagacagcatagagtgaatggagatggtatggcttagtgaaagaggtatgggctctcaagtcaaacaagtctgagtctgagttcaggcttaccattaaactctccatctgtgaaatgaggatgatcgtttcctattgtagggctattgtgaggattattagcaatcatgccccagatatagtgggtattcaatataagatatacagtgtgaattctctttagctcagactcagttaactaagtttggaaagaaagacatgggtggtattccagttatctatttctgtgtagcttaatacaactgtcatttagtttgctcacagatctgtaatttgggcagagctcagcaggagggctcattcctagttcacatggaatcaactggggcatcttggctgagggctggatcctctgcttccaggatggcctgtgcacacatctggcaagttattgctggctgttggctgggagctcagtggaagctgaggactaggaacctcagttcccatgtggcctctctacatggcctgagttctaaggataagagagagggagaaagagagagagtgagagcaagcaggcagaagctctgttgccttttgtcacctatcctctgaagcccatagtgttacttgcaccatattctcttagtcaaagcccacccaggatcaagagaaagggacataggttctacctcttgacagaagagtggcaaagttctggaagaacttgtgagatgagaaatattgctgtggccattcatggaaaatgcagtctgccaccaggagttttcagcttctaccttaaggctttggacttggaacccatagggaagtgatttctgaggtttacagagtgtcatggggccgggcgcggtggctcacacctataatcccagcactttggaaggccgaggcgggctgatcacgaggtcaggagatcgagaccatcctggctaacacggtgaaaccctgtctctactaaaaatacaaaaaattagccgggcgtggtggtgggtgcctgtagtcccagctattcaggaggccgaggcaggagaatggtgtgaaccaggaaggcggagcttgcagtgagccgagatcgcgccactgcagtccggcctgggcgaaagagcgagactctgtctcaaaacaaaaagagtgtcatgggcaccatgtgcgacatggaaccaggaggtgggggacatgagttttaatcgtatcaccacgcagcagtctcctcttacacaaagcactcacctggagccctggacttgtcatttgtaaccagatgatgccctcttcagctttactcttctccagttctctgagactgtgaggtccgggcactgtccattccaactccgacatgtcagccatggctgaatcagtgcttctccatccatcttcttttcacatcggaattgctagaggagctgtcaaaaatgcagatgcccaggttgaaatgatcaggggtgggatctggacatcagtcatttaatttaaaaaaaatttttttagagatgggttcttgctgcgttgcccaggctggtctcaaactcctggcctcaagtgatcctcctacctaagcctcctgagtagctgggatttgaggtgctagccaccacgactgactacatcagtaatttccctgggggtgatattaatgtgcagccagggttgagaatcggtgagctccgccattgtgtccatctaagtgtgtacaggagtcaatcaaaggaacccaagtgtagccattgcttttcgtgcccctgtgacatccttttgagccatctatgagaccagccacagaagaggtggacagttctatgctcgcagacttctgtctgcctctggggtttcccccgagccctggcagcctgctcagctgtcacaggaagagcccaggagtgcagaggaagtaatggcccaggagcaaatgtcaactgttggggagggagacttggataaatgccccagtctccagcccttcctagagacaattctagaaggcattctctatgcttctcagaggtctctttggacttgagctcccactgtccacaacaaacaccccaaacttggcttccatccttccctgtctctttctccctgcctcctgggattacctcccaaagaaagtacttgcactccagtcttgatcttaggccctgcgacccagagaacctaaactaagatgccaagtgatcactgctcaattgtgaactggcaaagagtggtgtgaactaagggaaattggaaaaactgctcgccacagccaaaccactggtgcacgcacccctgccacctttccaggcacttctgcacttaaaactcccacaagcgactcttgctaacccatacatgacagatgctttgatgagaaggaaagtgtcagctggctagcagcagaatcactctagacactagtggagttggggaggagagggttctttcttcacactctatcttttctggaggaagcagagataaccctacagcaggggtgtccaatcttttggcttccccgggccacattagaataagaagaattgtcttgggccacacgtaaaatacactaacatgatagctgatgagctaaaaaaaaaaaaatcacaaaaaaatctcatagtgtttcaagaaagtttatgaatttgtattgggccacatgtggcctgtgggctgcgggttggagaagcttgcctaggtcatgcattctcagtggaggcgctatcatccccattggggtggaaaattggttcttggtagcaaaacaacaacaacaaaaaaaaaaaaaaaaaaacacaaaaaacgcttatatatgacacagggccaggactaggatgaggcaagtcaggggcccagggaagaaaatattaaggagacagccactcccagggctgtggatgtccgcatatggataaacatattaactcgccagatggcaacgagcctgtgcataaagagatgaaaaggatcaggcagaggcagaaagtgttgcagtttgaaatagactggtctggaacagcctctcggagaaggtgacatttcagtaaaatgtgtaggaggctctgtagcaaaccaaggggccttctgggggaaaagtgttccaggcaggtggaacagcaaaggcaaaggccctgaggtgggaatatgcttggtgtgttggagaaacggcagggaggccaggatggctgagtgaggggagggcaggagaagataaggttggggtagagagctgtctgtttcatggaaatgttggggcgattccattgagtgaggagcacaggtataaggccagtgtcatcagtgtccaataaaggtgagtcggcctcccgctttccccactcccaaagcgctaagcagcatttacatgtcgtcagactgaaatagctctagaagctaccagccttcggaagttacaccaatcacttcggaagtgaacagaaatcatggctagcattctaaatgaaaagcacagccatgacgctccattatcagcacgggccaggaccagcagcgtagattgctagccatgtgtctagtttcagaggcactgggaagggcggggaatgatcccccagtatcctctactggtcagaaagttaatttcaaggctctcattcttcctaaagtacacatccctcctggtggagcacggtggacacccagtaggtcagtggcccttccttctcttcagcccacagcccaagatgagaagcggcctggtgtagtgaagctggagagcctgcctcacatcctagtctgcccttttacatgtaatcttgggcaagttacttgactgctcttttcctccatttccctatctgtgaaatggggataacgtacctcatagggttgttatgagggctaaatgagctaatatttacgcagtgcccggtcatatagtaatgctgtataagtgcttgttaattaaagatagaccccctttgggggctctaatcttcccaggaaaaaatgcatatgaacacacatttgcattttatttcggggcatttatggacgctccaaaatgcatctcgtggacccttggggaagggacagttcataaagccctgagagaaccaggatgagttctggagggatcaagagccagggggatgggtgggcgatactgtgcgaaggcaggagaaaagcaagaattgggggctgggggctcaagaacacatttcaccttcttcccgttctggccaaagcccacctagaactgcggattgcttgcactttgggaagttccatcagctaagagccgaagttttttttaatgatgtcattattaatcatttaataaatacattatgtaagagtacttattgagcagtgtcccagcgcgagtaaacatgttttggatatgccaaattagaaatgttttcattcagttttgggggttatgtagtaaactcggaaaatgccgttcctggaagagtgtctgttatcccaagcccttaagagccagtgtaataacaacaaaaatattgttctgtttggggttcccatataagagtgcctaggcgtggtggcttgtttttaattatctctctatggaacagtaattcaatccagaggaggactgccaccagattacaagtttcagttgggttgaaaatattcatgcaaggagagctagttgtaatctttttagatccactcccaaaagattaagcctttttctttcccatccaacttggggaagaatgtggtggaagtaaatactcatagtagtaccacaatcataggtgtaagacaaccatctcacatttgaagtcttaatatctaccacggtgtcaaatagcagggagaaaaatgaacacttcagaaacacccagacatgatcttgcataactttggtgcaggtagtttatttgggaggtgatcccaggaatcaggagtgaaggagcaggcattaggaaaagagagaagggagaaggcattaagaaaagaggaaaagtcattaacaggtatgttattgaggtcaccactgtaggcaatgggggctcacaatggctgactttttaatgctgtttttgatatgtatttgggtggacattttagcatacatttgtaagacctgttaaggcatctatctgctgtgatcggcagctataactactcctccaaactttgaaatctgagtcatagtcatccaagaagtattcttgagtctttgctctgttgactctgcattagtcattttgccttgttactttcagatccattccccatccttcccttactctgtatcacagggacctgaccccttgcaatatctttcatgtctccttgccaactggcttccagctaggttcggccagtgggtgtcagtgacaggagattggagtgcaagaggaaaggggaagtcagggtatttctccccctctctcggtttggctggcatctctaatgggggctgtgcctcttccatgattccagtctcactggacagaccccttccaacatcccgtggcctgaactcctgccttgtggctctgttcatcggtatctggtaatattacctcccccctttgctcttccagaatcttcctgctgttgctcacctctggattgctccagttcttcatctttgcaacatttccctgtgttacattcctgctcttgaactacctgtcatgggttcccaactgatctctgactgacggagatttcttaaggatttcattagtcattgcaaaaatattttaggacatcaaccacaaacaagacactggactagattcctggaaggtaataaataaagcatcaagcagcttagcgtctagttgggtaaacaaggcacacagtggaaaagttaaatgacatctttccaaatgccaagtgaaagaagggcgtagtcaatgaatacttgaagatataaagaggagagagccagctccatcagcttttgtaaccagggcatgctttagagggccagggagccgacataaaggggtcatctcccaaaacttacaattttgtaaaacaaggtgaaaaattggaattttatttgaaatttcctgatttttaaatgttggtgagtaattcaaattttcagtaacttggagctgggcatggtgccacacctctgtagtcccagctactcaggaggctaaggcaggaggatcacttgagcccaggagcttgaaacccccatttctgaaaaaattttttaaaaatatccaggtgtagtggtatgtgcctatagtcccagctactcaggaggctgatgtgggaggatcccttgagcccatgagtgggaggctgcagtgagctatgattgtgccactgcactccagcctgggcaacagagcaagaccctgtcactaaaagaataataataacaaaaaactccagcatgattcccactatgtagacaagataaaacttgtttggaggctgaattgagactgtgggtgtacaattggtggatggattactgtatgggggaagaaatgggatgcagagaatgttaggattccttccaattagaaggttctaaggttctaattttacacccgggtatgaggcagtgacggcctgggtatggaagggggcagtgagcatggggagaagggacagatgagagagagattaaagaagattaataataaaaccctatggccaggcgcggtggctcacacctgtaattgcagcactttgggaggccaaggcaggcggatcacttgaggtcaggagttccagaccagcctggccaacatggtgaaaccccgtctctactaaaaataccaaaattagccaggcgtggtggcaggttcctgtaatcccagctactcgggaggctgaggcaggagaatcacttgaacccgggaggaggagcttgcagtgagccgagattgcgccactgcactccagcctgggcgacagagcgagactctgtctcaaaataataataataataataataataataacaacaccccccatttctgtattcgattatggtctacagagtttgtcattggaactgggatagagtagagcctcagaggttaggctcagaagtcaaactgccttcgttcaaatctcaggtctacaagcaatgatctgtgaggccttgaacaagtttctaaacctcacccatcctgtttctcaagcactaacaaggaatgatgttaatgatatcacctacctcttcagggtcgaggagtccttctcatggcataactctgacccactcttctgcctgcctcttccacttttaagaactcatggactagattgggcccacccaggtaatccaggataatcgatccatctcaggatcctcagtgttcatcacatttgcaaagttgttggctgattaaataataaagtatgtttgaagtccttcatgtggtaagcctggatcacaggaagcgtggatcagtttttgctattcctgttatgccatgtacattctctctttgagaatccttgcaacagccccatgctacaatgagaagactgcccaggatgcaatgactggatatggaggtgggagttggggatggggaggagtcaggagcaatggccagagagttagcatcttggtttgtagactcgactctattgttaaaagtaactctttgtttctgggctcttcacttgacccctgtaggattttctctcttgaagggcggttccttgcaactcattctccataatttaggaaactgggtttctgagtatggtggaaagactgatggctccccaaaaatgtccacatcctaaaatccctggaacctgtaaatatgttaccttacatagcaaagggaactttgcaggtgtgattaaaatgaaagaccatgagattatcgtggactacttgggtgggcctaatagctcttaaaagtgaagaggagtcagagtgatgccacctgagaaagacctggccctgtcccatcatggctgactttgaagatagaggaatggggcatgagccaagaaatgtggggggcttctagactctgggaattgaaggaatggccctcaatgtattgctagcaagaaaatgaggaccttggtcctacaaccacaaggatctgaattctgcttatcctgaataagcaggaaatggattctcccctagagtttccagaaaagaatgtggcctagcatcatcagcattgattttaatctggtgagactcctactggacgtctgacatgcagaactctaagataacaattttgtgtttgaagccagtaagttaatggtacagcagcaacagcaaaccagtactgaagttttcaacttaaatgtttggcgggtgttactggcaatacttttgagttcaggaactgatcaagggtggaaatgatgtggggtgatgagggatgagttcttggatatactgagttggagaagcaatgacagcaagacattcacatggcagtgctcgaaccacacttggccatgtgggattagagtttagaaggtagtggcaataactgaaaaaaaaaaaatgcctgggaggggatgtagggaaagagactccattgatggggccagtttcttgagtttccagttcgtctggctccatttggcttctattctaagccaaactcctgctcatcctaattggaatatatggactttgttttaaaaaaatcactagggagtcatactgagtaaattttatagacacggcaccataattttatttattgacttaaattgagacttccataaatgaataatgcttgaaaattggctctttgtaggttccaaaggaaaatctgaaaattttaaatgtttttcctttctttgtttatgaatctttttaacaatggaaatgttttgtctcctaagagtggcatggagctcaaatatatgactcactggatatgacgaccacctctttaagttgtaacaaatgggaagtgagttaggagagggcccaagagaaacataagctgatcctcagaaaagtgtaagtcctgtggggatacctctaggttggaccaggagtgaggtggagcatcataatgagagacagaaaaagtgaataaatgttagtgactgagcagctgggttcctaaaggaaaaagaaatgccaaaagaaaaaagcagagaagaatcatttaaaaatctctagctttaatttactagattccctcccttcatcaaagtagaccgctgtctttcctgtcaggagttactgagagccctgtacatttcatgatgaaagagaccagccctgggctggtccaacccctcatctactttttttttttgaaacagagtttggctccgtcgcccaggctggagtgcagtggtgtgatctcagctcactgcaacctccgcctcctgggttcaagcagttctcatgcctccgcctcccaagtagctgggattgcagatgtgcaccaccacgcctggctaatttttatatttttagtagagacggggtttcgccatgttggccaggctggtctcgaactcctggcctcaagtgatcctcccacctcggcctcctaaaatgctgggattatagatgtgagccactgcgcccagccttatctacattttgatcaagtttcagctcttgattataagcccacgcctatcaaactcagggatggaggaccagttttgtgagtttcccagaaaacttccttctctgctctggctcttctcttacccttgacttgtccatttttttctaataagtaagaaagaggtgaaactcaaatcagccccctgtgtgtacacagctgtggtcaacagatttggcagtggagaaggttggaactatggccatccaccgggcaaaattgtcagtgaagcaatgttagcctctgttgcccctcgacgtcactctccatccctcttctctggtacctaactcttcccaggtgccttcatcctgctccccgcctttgccaggtgcctgcccttcttcactttacctgcccacactgacaggtgtcattctgagggtagtccatattgaatgttgattttacccagggctttcccacgttgcccagtgtggtagctctttgctagatgatcagatgaattcacccaattcaaatgaactcatactaagatgtgaatgactgatgaccccttcagtgttcccaaaggtattttttcaattaaccctttcaggctgggcatggtggctcacacctgtaatcccagcactttgggaggccgaggtgagtgcttgagcctcaggagttcaagaccagccctggcaacatagtgagacccccatctccacaaaaaataaaataaaaaaattagccaggtgtggtggtgcgtacctatggtcccagctattcaagaggctgaggtgggaggatcacttgagcctgggatgtctgaggctgcagtgagccacaaccgcaccactgcactccagcctgggcaacagagtgagaccctgtctcaaaaacaaaattaaccctttaaaagctaactcaacagattagtggaatattaaagtagcatgagagatacagaagaacagagactaaggaagaagtaactgcaattaaattagggcaccaaagcacctagccacttgcctacatttgccttgttggctgcagggttattggggaacttgggcactcattcagtcctgctttcgagccgaactatgattttaattatcccagaaaacaatcagtaccctaccatcatttcaagaaaataggctcctggaggctaccaggtatgtttcactgtgcaatgttagtttgcaaacatacttattctttcctattaattgtatctcaagataacattgtaaaaatatccctttgtaattaatttttttaatgtataagataacaccccatgtgggtcagtatttggggatgtaacacttctaaagggtagtataaattggtccaagttttctctagggcattttgcaaacaacatttatggaatttctgaaagaaatagccacatatgtatgtaaaaatttagcccaaaggatttattgcagcattgtttgtaatcatgaaaaatcatacacaccaaaatgcccattaagaggaaatttgttatatagataaatagtacatacaacaattgaagtgctattcagccatcatagatggtgttgtggaaaattgtttgatgatatagaatgacgttcatgatatattgtcatgagaaaaatcaagttataaatatttttgtgtgatataatccttatacatacatatatatacatataaacatatatgcatgtatctgtatatatgtaaatatatacacatataaacacatgcatatatctatatatgtaaatatatatacacacatagagaaataatatatactaacatgttaatgtcatttttctctgagtggtgaaattatagatggtttttattttcttcttcttgcttatctgtaatttctcgtttctccaatatgtatgtattattttcatagatagaaatatagaattacttttcttttaagagatctgagcattttccccaaataaataactcagcagctcttgtagtttataaacccagaggtgtctgatctagcttaactcataagaaagaaatggcttaatagatataacgtctgtgctcaaaagcagcacagttaatggaagtttaatttatgcaaacatacacgttaaaaagtattgattaggctgttgaaaataatagtaaattaacatactgccctcttttggtagctatttgtaattcagcttacgttcacttccattaaagatgttaatctcctacaaatgtgtgcataaattaaactaattttatcttattttttaaaataaattttattgtgcacatttgaggtttataacatgatgggatggagtacatatggatagtgaaattgttacagtagtgaggctgataaacattcacatacttttttttagtgacatgagtagctgaaacctacttatttgacaaaaaatccttaatatagtacaattttattgattttagtcctcatgaaactaattctgaatcacctcttttcctcaacagaagatactgataattccagtttgtcaccaccacctggtaagttgtttttttagaactctggggaatttcaggaaaatattattctgtaagttctctatgaaacatggcatgtagtcaggtacaacaaaattgttttcctccaagaagcttaattaggtcattaagcctacacctgaaaaatcaatgcaagcatagaccagaggacagtcatattgatccgtccatattgcgggacaaagccaggcaacaaatcacaggggactaaattgttagttttcattacagtaattacttaagttcagcagttatttttagtattctagttcacaagtctcttgaagagtatcaggaacataaacatgccagatgtttttacatttaagggaggagatgagatgagatgttcacttaaatatacaccctcagtacctccactgaaaggatatttttcactaggattctaagggcccagcactcaccagaatgggaaggcaaatacattagaacccagattggcaagtgcctggaacagaacctgaattcgagactgctagctggaatgggaccttagggataaagtgacccagccctgtccattagttgatgagataatgaagcctggagtggctgaggaacttctctaagatcacacagctccttgctccacatcacacagaggcagcacatggcttctctgactcctacttctgtattcttttgggtacaccatctattccagaacaatcttttatgatggggagtgagtcaactcacattctttctgtagttgtgtgcaaatgagcttctactgttattgattcattatttaaatccaattaatcacaatagctatacttctcatgcactactatgtatctggaagccttcagacatctcctcgttctcctctcagtcttgcagcataggaaatattcgtgttatagatgaggaaactggggcttggggaggataaaacatgctcgtgttcacacattctctggagccagatgacttgagttgtaatttggccaccaccttcctgccttcattcctagctgtgtggttttgggctagttcctttaacctttccatgcctcagtttcctctcctgtaaattagggagaataatagtagctgttgtcgggtagttgtgaagacggaatgagataacatatgtgccaggcacagtgtaaacccttggtaagtggtaactattatttttacgagtttttgagtaatggggcaaagattcaaacccaggactgcaggcctccaaagtccaagctcttttgatctcgccaatttgccccctagttgttaagcttctagggcacaatgaaccactatatttttcttccaatagaatagtccttagcaaactgaatcatggtgatatctgcaaaaccttgtttgcatagaatagggaatgggactctggggggacacactgggtctagtcacagcctggcttctgggtgccctgggggagagcagtgcaaactggaaggtaagagccagtgtagcatcaagggatggatgggcagccatgcccagaggtctcttctttgcacagtgtcaccattcatcaacattcggaagaattaatagtcattccttaaaaactagttgtggccaattattttgttctgccccaagagcaaaaaggattctatatctacactttgaatcttattgctcaggaactgtcttacttctcaagaaatatccttggtaatttaagaaataaataaatgtagtaaatgacaaaatatggaaacaataatgtggacagacagggtgtgtgtgtttcagccaacacaagagcagtctaaagcaggccagccaaagtgccttgacacacccaactttggtccataccagctgaaaatcaggctccatactgcaaaacttattttagttataaaatgttggtgtttgcttttcccatgtttaggtagaggtcaagccattgaatcttttaaatatttaaatatgcaaaatgtgtgtagtagattgacttcttagcttaagtggagtcattccacaggaaatttatcacttgattaattgccttaatagcagccatattttaaaataacttaccaggaaatctggttaggtagtacagtattgagtggtagcaatttttttaatcctaaatttactgtgggaagatttgctaggcatcactgtaacagaatggcaccagcgtgccaatatatttcatgattgtaattcggcaagttatttaaaatgttttctagaatgctctggctgaaaaatttttaaagtagtatttcttgtattttggtctggttcctaatcttatttctataatattccataagtagttagcaagctttgcaatcacgggtctcaggttcactcatcttgggttcttttcctacaattctctgattaaattttatactcactgagcgcttatgggacatgcagatttaactacaacttggtctgctagtgtgttttctacttcttttcgtaattatatctcaaaagttttaattctttaaaatttgacaaataatcgtttcaaaatattgatttaatttttttttctcctgcagctaaattatctgttgtcagttttgccccctcctccaatggtactccaggcaagattttgaaaaaatttaaacctagatttagtccaatttgttaaagttttgttttaattatatctttgtattgtttttctcctcgggacaaaaagaggttgaaacaacaagcctcaatggtaagaatttttctgaagcaagtgaaaattgataacccttaatatgaatataagtataatgaatggtgttgaaggtttccatttctaaattatttctgaatacgtcgagtagtttcaaataacccaaaacaaaacttgccaaccctggagagtgacctaaactttctggttaaatgataacattcttacagtcatggagggaagagagcagtccaccactctaattgttagctaaaaataaaagaaatatcgatcacattttgaattatccattcccttgctgtccaacacaatgccaacaagttttacatgacagattgtttaaatgtgaaaagcacatccagttattcaatatgattcagcatggatttggaggcacagtgtgttcaaagacagcctttttacagatgatttgatcaatttttaaatagtatgaaatgggaaaaaaatggcttccctatcatgctagagaaaagggcaaagaagtgggctttattcaagggaagggggcagagcagtacattctgttccctccaataagtgaacagaatgggtagacagccttccttccatcttattgcgatgaaaccccaacacttttcacaagcccttggttaaaatcaaatctcaccatatggttggtggctaaggagctaaacaatcatagatgcagcttatactgatcaaaactggtttaaattcatatttggcccaatgggaagggacagatgttatcatttttatgtgcagttacttctcacagtgaaaataatatcttcaatttagctttggtgcagtttttggatcccattttgtgtgtgtgtgtgtgtgtgtgtgtgtgtgtgtgtgttttaagtatgatgtaataaatgccttttggttttttcctaaaatttcatccagaatcataaattctagaatgatttggatttaaagaaatgccaatagaatcgattttaaattggattttaaatcaaacaggatccaaatgagattttcttaaaagttagtcgaatataatggtcatttactccaaatttaagctagaattattttaaattgctttataagagtgtaccactggtaaaaatgtattatgcatccacagggctatatattaaaatcagtattaatgttggaaatgtcatatcccttagggacgttcattataatagagaaaaaagggacaaaatattaaacaacatagatgagtttattcaaatctaatggttacgggagtgttgctaagtgtttagacatgtaacttgcatttgaatcaatgaacatttgctccggaattgtctccaggggttggagaatggagtagtgagaggatgggtagcaaaaacatttagtagtgtcagttggcttttgcaaaactaacttctcccagatttggggaaaagggaaatgtttaaggaacctaggaagacacacatgtttgtaaaccatgccagtagttatgctaatttttattattttatttcagatgttactttaagcttactcccttcaaacgaaacaggtaatatcaagtgatttctaaatgtaatagcttcttctgcagcctcttgagtgtcttgcttgtgcagtctactgggttactaaagagttttcttttgcctccttgccctttttcctgtgccttcaaccattgatttatgacccctttgactttgacattgaactataattctgtcaccacactcccaaacttccaaaggatggccatagcactccatttaaaatagcatgtattatttttgtgattataatagtgatacatattagctcataaagatggagaatatagagaaatgcaaagaagaaaatacaaatcatctttaatgttactttcctaagactatgactgttaacaatttggtctatttccattcagtatcatttatacatatatttatatacatatactcttatatcctttgcaaaatagtcataatttacatagatttttgtatcttgcccatttgacttaatattacgttagaagtatattccagtgtcccttactattatgacttgataatattccattttgtaccatatgttgaactttaaagttgtttctatctttttaatagaagttattgcaatgaacattctggtgccaacatctttgcattcatttcttatttctgtaagatacattctaaggattgcagtatgcaaggattgcattctaagggtcagcagtatgaatattgtaagactcttgatactactgcttggttaccttctagaaaggtcgtgcctagcgacattcctgtccgcagtggatgagaatgtctgtcactgtacctttgctgagactgtatcatatcttattaaatctttctctcaacgcttaggttttatttttcattcatgattactagtgaagttaaacatttttaccccagagcactttagttaccaaaaccagaagttcatttcacagttgtattttgtttgctctgaaaaggaaactatcagggcaaacaaaataatatatttaaaagatttttttttttttgagacggagtctctctctgtcatccaggctggagtgcagtggcgccttcttggctcactgcaagctccgcctcccgggttcacgccattctcctgccttagcctcccgagtagctgggactacaggtgcccgccaccacgcctggctaattttttgtatttttagtagagatggggtttcactgtgttagccaggatagtctcgatctcctgaccttgtgatccgcccgcctcagcctcccaaagtgctgggattacaggcgtgagccacggcacccggacctaaaagattcttaatgacaatgtgaaatgctatcagccttcataattaccacccatcattggctcatgggtcacacattgaaacctgacagtttcagaaacctcatttgtgtgtctttgttactgatgagtttctgccaggataacatcatcattcttaagtgtgtttccaatctctgagcttggccttttcttcagaatttgcccatccaccctaggtgacagagcttcggtgaaaatctatgccctgaacacagcctctttccattggccatttttacagcaaagatttctgtacctgcttctccgttacctggggaatgaaccatgggctctgtccccaaaacgtgtttggaagacatttctaaagtttgcttcttcagggcatgttaatatttgcctgtgagtcactcactttgaacagtcttggttctgctgtgggcgtgttatgtgattgtgtataggtggatgatctcgacctctctgagaatagcattctctatcagtacaatggggatagtattatgttaactcctaaagaagatagcgagacacttgattgtataatagcaatactttacatcccatgtgtactgtttcacattaatttttattctgaattacctgtttttacaacctatcacctgaaggtcccgatagtggcttaattctacatatctgaagtgtaagtccacatcatttgtctagcagcagtgtgtggaaagtaaagtagaattacacaggcagtggggtgtgtaatgggtgtgatctaactgcgtaaacatggaactccaactcccagactcaccctgtgccaatgctacatgatccgtggatgcggttcctattcattctgctgctgagatgaccgatagtgtcttaaaggtgtcaacagtgtgactttttttttagcacttcactaaaatgatactcatggcaaattgtttttaaaaaacaagcaatgattattctctaatatttaagttgtttctttgcagaaaaaactaaaatcactatagtaaaaaccttcaatgcatcaggtatgacttattatcaatatcaagactttcctttttataactaaagtaaaattaaacaaatggctggtgtttataatttctttctcttttttccaaacttttcaagataaaatctggtcttaacaaacagatgtgtatgcactgggtacctgaaattgtactaggtgtttggggctatataataatgatcagacacagagcctaccctcaagaatcttctagtctatgggtggagacaaggcaaaaaaatagataactaacatgaacatgcatgcagataaaggcaatgattatacaagtattactgacatggttaagaggcataggagtagagggggatgcaattaatgaagaagttagaggaatgaacctcaaatttttttttcctgagacaagatctcactcagtggcccaggctacagtgcagtgatgcaatcatagctcactgcagcctcaacctccttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcactaactcaaattataattttagtttgtacccaaactagttttctcatagaaaagaatttaaggatttgtaatgtgcaatggaaataaacttgcagttgggcattgcacacataattctgaccaaacaagacctaacaaggagacaaaaatatttcttaatataacaagtttttcccttggcagtttgtttaatacattatcagcatttgctcctcccatgtactatggatttcttatgctttgccaaaaggatgcaattaataaaggaaggctttttagagaagtaaaccttgagttcttttcaaattgaagaagagatacacttctcctctcaccaaaggagaaagtgtttctcaggttaatacgtataaagttttggttctgatgctcattttatctcccagtcatctctgtctcctttgtatgcctgtgtggtctgttgtcctggtcatcactccattttgccctcactaataagtaaattaaaaaatgctttttatttactggctagtatcatccactagattgtatgctccttgagggcaggatctatatctggaaactcccaaagcctgtagaatatggttaatgctcagcaaatatgttttgaattttgtagtttttgcccatgaaacaatattatgacattaatgttatttcatacatacatttgcataaagagctaggattaacattagagtgttcatagactcccctacataggaaaagaaggaggatctatgattaagggccattccatttaaagtctctacttggtttgtgttcatggtgctctgtttatactgaacaggagagggattaattgggaaggggtcaaaaattttagggaggagttaaggatcagatattgacatactaaagattagtaaagaattaagttccgtagctgacaaatgaccaacaaatgaaaactcatttctttagtctttgtggaattcatccatccaattaattccagcttataatatttctggtccacatttgatgcctacgtttatgaattctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctccttaaaaaaaaaaaaaaaaaaatcaccatgctagctaaggagttttagaattttgggagtaaagaaggctttcaattttagggaaaatgcagttttctgcagtatgaagtttccacttggaccactgccttaaaccagtggtttgaaatcttagctgcacattagaatcacctggggagcattaaaaacactgactcccaagactcaccaactaaatgttttgtcattttaaaaacatgtttgacggtctgataggtgagaaatggtagctcagtgttactttaatcaacatttccttactaaggcagagtctgaacattttttcatatatttgggggctgttttgtatctttttgtgaattacatgtacatgtcttttctgtattttttctaattgatatctgatccattatttaagagtactttagccgggcacggtggcttacgcctgtaatcccagcactttgggaggccaaggtgggcggatcacgaggtcaggagatcgagaccatcccggctaacacggtgaaaccccagctctactaaaaatacaaaaaaaaattagccgggcatggtggcgggcgcctgtagtcccagctactcaggaggctgaggcaggagaatggcatgaacctgggaggcggagcttgcagtgagccgaggttgcgccactgctctccagcctgggtgaaagtgcaagactccgtctcaaaaaaaaaagtacttcatatattgtgcatattagctctttatatgcatatctatggtatatgttgcaaatattttctcccagtattttagttgtcttttgactttatcatgttttttgtcatggaaattttgaaacaattttatgtagttaaatacgaaaaagttcatcttttccccagtgatctgagatgtcacctttgtcttatactaaattttgatagacatttgggtctaattctggatgttagatgttaacactgggtgaccaagctgcgtgggaggtatacagagctgtttgtattgtttttatagtatttctgtaaacctaaaattagttccaataaaaagttaaaaaaaaatactgattcccagtcaccaggctcagagattctgatttaattggcctgggatatagcctaggcattaaggcccttctggaccaggcaaggtagctcacgcctgtaatctcagcactttggaaggcccaggtaggagaactgcttgagctcaagagttcaagatcagcctgggtgagatctcatttctactaaaaaattaaaaaaaaacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggaggacaggaatgaaaatgttcactgtggttccccatgagtgacctgcctgctggcattatgagttttgtttgttttttttttttactttttcttttctttcttactttgcagcattttctatattcttctacaatcagataaaaattgtatttggaaaaaaaggacttaaaaaaatctgtgtagcttctcagatgggaagagaaggctaagtgtagcctgtctgccctttgtgggccagatttctgggatatactaatattaaaacgttggaccttgaggaacaggtaaaagtctttggttaaggatttgtagcaggattttctgcaatagaaagtaaagagtaacatgccccattcagcttcacatgccccattaagctggagcattgagccccattttggggatagagtttctggaagcattgggatcggatcagaagagcatccctcttttgacgcagccccactgacccctagtggctgcccctagtggttaagaagaagaaacaggaatagaaaaggggtcaggatgtgaaactgatgtccagttagggctcagtcattaactagctgtgtatccgtgttccagagcagatgcttttttaccttcagcatctcagatcaaatgaagaagtgagttagagctctgtaaaattaggaaatggactggatcaacacttctcaaatatcaccgtgcacatccatcactcaggatcttgttaaaatgcagattctgatccagtaaggcctgggcctgaaagtctgcatttctgacaagctcctcaggtgaagccagtgttgctggttcatggaccccactttgagcaccgagggtctgtatagagactgtagagcagtgctagtggttctcaatcctggctgcatgttgaaatcctctggagcgttttaaaaacattgatgcagctgggcatggtggctcacgcctgtaatctcagcactttgggaggccgaggtgggaggattgcttgaggccaggagttcgcgaccagccagggcaacatagtgagaccctgtctctacaaacagtttttaaaaattagccgggcagggtgatgtacacctgtagtcccagctgcttgggagactgaggtaggaggggtcacttgagcctggggagtggaggctgcagtgagtcatgatcatgtcactgcattccagcctgggtgataaagcaagaccctgtctctgaatgaatgaatgaatgaatttaaaaatacatcgatgggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaataaataataaaaaataaaaaataaaaacaaaaatacatcgatgcctgcctcccaccctcagagactggtgtaggatgtggcctgggcttcccagtttttaaaaactcctgggtggggtggttctaatgtgcagccaagttcgagaaccactgggctagaattagatgcccacccagggtctttctaatatgttggttcttaggtttaactgtacattagaaatacctggggtatttttaaaacatactgatgtgtcaaggtggccttctagggtgctggaaatgctctgctttgatctaggtggtgattatatataaaattcgtcaagctctaaatctaagattagtacactttatgcaggctacaccgcagtaaagaagcacattaaaatgccatgcattaaaatgggcactgcgcccaccgccagaggttccaggtcagctggtttggagtgggagcccaggcatcggtgccgaggtactctgaggggttcagatgtactgctggcattgcccaccactgctctgccgcttccctgtgtgcctcacagtggatggagggctctgactagcataaatgacaggagtagaaggcaacctcttcacagttgagcccagtgaacggggccttctgaaggcccccagataagctgaagaaaatttaatgtatactttgcaaagcacctttaccccaacttggccaggtgggttgctacagtgtacagtttagggaatggagcctgagagatgttgggtaaattgtccacaggagtagtgaaagctggagccctagtgaaggttgtttgttcgtttgtttgtttgtttctgagacagagtttcgctctttcacccagactggagtgcagtggtacaatcttggctcactgcaacctccgctacccgggttcaagtgattcccctgcctcagcctcccgagtagctgggattataggcacccgccaccacgcctggctaatttttgtatttttagtagagacagggtttcgccatgttggccaggctggtcgcaaactcctgaccacaggtgatccactgcttcggtctcccaaagtgttgggattacaggcgtgagccatcgtgcccagccaagtctaggctttttgactcatgatgtttctgactgtctgacaccctttatcctcactgccccgaacctcaggggatgcagggaggcctgtggccaagtgaccagccagactggaccaagcaggcttttctttttatagatgtgacttgctttaggccccttgacctaatattcctccctcttctcaccctagagaagctctaagaacacattcttgttggtgttctaagtctccatctgacactagatcgatcagaggcttccttgagtaaatattccctgggtaataatttgttgctcctcctctagttgttcctccctagatctctcaagactgatggatcttgtgccagagagtaggtgaggacttctccacctttgatgcccatgaaaatcaccagagagtttagaaaatacatatgccccatcccaagaccagctgaatcaaacacagaggagtgggccatagaaatctatatacacatatgttttaaaaagtgttctgggccaggcacagtggctcacgcctgtagtcccagcactttgggaggctgaggcgggcagatcatcggaggtcaggagttcgagaccagcctggccaacatagcaaaaccccatctctactaaaaatacaaaaagtagccgggcatggtggcaggtgcctgtagtcccagctactcaggaggctgaggcaagagaatcacttgaacccaggaggcggaggttgcagtgacccaaaatcacgccactgcaccccagcctgggtgacgagtgagactctgtctcaaaaaaaaatgttctgggtagttctcatgcacagccaaggttgagaaccactgagctaaaggaaccttgaagacacagctgctgtagaccacctcttttgccccagcttgattcattgttttcattcaaccaacatttcttggtcagttaccatgggtcagctaccactatgccaggctatagcagtgtaaagttgattaagacagattcctagtatatgaaaaccagttgggtcacgagacatttcgcagttcccctcacccgggagcacagagaagattccctcaattgagtgaccatgagacacagagccacagagcagcagtgaactggggagtcacagaagagcatctctccttgcccattcctctcccaggaagtaggtggtagaagtgggcaggggctgggggatagtggcaggtgcacagagggtgtgaaatggcagaggctggaagtgtcatgtccctgatgtaactacgtcaacttgacggtgtcagatgattgccagaggggaaagacttgccccctctgtagctcattcgtgtctcacatgtatctctctgatttgttcctttagtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacaggtaaatgtcacttgaacagcggccaatctgccaatcaagacatctatgataagaccatgttgagcctttctttgtatgatgttcgcttgatttctagagctttcctttcgggattctaacgttctaatgacttacatggttgcataagagtcattgtgttgaggtggcatatctaatttaatcaatatctaatttaatcattcctctcttctgaaaccattaagtttattctactttttagctcccaggtatcggtatctttcatgcagttgtcactttgcttcttggctgtggctgagttccattgttttgaccaagataatggagaaatagctctaaagggcaagcacagatctcatttgatggagttggagattttctaggtttctttctcctacaaaagttggttggaacactgttttcaacaccctgaagagtaaacttttgatctattaaacatagcagctcagcttagacagaagacaaaagaaaaaattggcaggtctgaaaatcagtcagtcacagagtgacagagctgggactgagccaaggtagtggtaggaggggagaaacactgtgaagacccaggcttgggtccgcacgggccctcgcagacagtgtaatctggaacaagctccttctgcctccgcctgttctatgcgaggatcaaaatcatcacactaactgcatgaggctgagaatgaaggtgtacgtgagaatgctgtggaaaccgccaaggcctccagggtccaaagtgggcttagtggtacagagataaaggcaagagggaaagaagctgagagaaatctggatacactgaagtttcagttccatgagtaagaggcaggtcttcctctagaatttggaggatgggggaggcaaagccaagtttttggtgacattagattgattttggtacccacctcctccaccctggtgccagcatcaccaggagatgaggagcttctgccaaatgacttcatatttcttcaaatttgcactgctctctcttcagtaaagttttttaaattgtttctttttttttttttttttttggtagctttggggtcttgctatgttgcctaggctggttttaaactcctgggctcaagtgatcctcccacctcaacctcccaaagcgttgggattataggtgtgaaccattgtgcccagccaataattttttataaatgtaaatattttcagccaaattagaaaagcattggggctgtagtcaaaggaaggtccaatggctgatgaagaatacagtaaaattgaagttcattagcctgggcctaagatgcccaccttcccaaagctaattcccagtgatccctagactcagcctaacaggctacacaaaacactatcaaggtggcctctggtgcctatgtattcctggggcaacaagaagcaaagtgacatattcataaaagatacagattgaggtgttacccaggagctaaaaattagaataaacgtaatggttccagaagacaggaatgattaaataagatatgctactgtaacacaatgactattatgcgaccatgtaagtcattagaacagaaacagaaatatacagaaacttgggggcattttcaagtcttgatgtgaggtgaaaatagcccaacaacaaatagtttgcacaccatgtttataacagtgtaaatacacatgcataaagatttgacgggaataggcaaaataataggatgttaagtggtgaaattaagagttgtctgttgttaaagacaggtttgtatcattgtttccctattaaaaatcagacttacaggtgatagtccagctttcataatattcttttttgttttgagagagagagagagtctcactctgtcacccaggctggagtgcagtggcgcaatttcggctcaccgcaacctctgcctcctgggttcaagcgattcttgtgcctcagcctcccgagtaactgggactacaggcacatgccaccacacgtggctaattttttaaatatttttagtagagacagggttcccccatgttggccaggctggtctagaactcctgacctcaggtgatccacctgcctcagagcctcccaaagtgctgggattacaggcgcgagccaccgtgcccagcccataatattctctttttcacaaaagagcttccagcaatccacataaaatcctgtacacatgatacaaattaaatacaagtatacttgtgcttatatgagtatatactaaatacactgatgtgctttatattttttagatttattgaagtaaaatttgcatacagtaaaatgtatccaattttatggataaatcaaatttttgcagttctgtgcagctagaaacacccacagtcacgtaaccaccatcataatcaagatacataagtttcccactactcccaaagttcccttgtgtcccttcgaagtcaaaacctaatcccctcacccccagcccctggccaccactgatctgtttccatacaggtttttggatatttctagaatatcatatgaagagactcacttagtatgtggccttctgagtttggcttctttcacttagcataatgtattggaaaactggagatccacccatgccattgtgtgtatttagagttaattcctttttattgctgaataatatttcactgtatggaggtaccatagtttgttgatccattctccagttcatggacattcgggttgtttctagtttgggactattatgaaaaaggccactataaacattcatgaacaagtcttcctaagacatatgtttgtatttatctggggcaaatacccaggagtgagtttgccatatcacagggtctatgtacgtttatctttattagtgggttttccattgtgtgttcataacacgatttggctctttgatatagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaaggtacgacttcgcaaactgaagtggtggtaagaggggaccctccaaagataaagatgctgctcacatgattaatatcaccaagtcttttactcccaagtaccaggtacatcatggtttctcaggttgctactctatattctgcttagaatgaggagacagatgggactgccaaatctacactaccaaccttgaggccagacattgtggctcatgcctataatcccaccactctgggaggctgaggtgggcggatcgcttgaggtcaggggtttgagactagcctggctaacatggtgaaaccccgtctctactaaaaatacaaagattagccaggcatggtgatgcgtgcctgtagtcccagctactcaggaggctgaggcaggagaatcacttgaacccaggaggtggaggttgcagtgagccaagatggcaccactgtactccagcctgggaggcagagtgagactctgtctcaaaaaaaaaaaaaaacaaaaacaaaaacaaggctgggcgcgatggctcacgcctgtaatcccaacattttgggaggccgaggcgtgtggatcacgaggtcaggagatcgagaccatcctggccaacatggtgaaaccccgtctctactaaaatacaaaaaattagctgggtgtggtggtgtgcatctgtagtcccagctacttgagaggctgaggtagtagaattgcttgaacccaggaggcagaggttgcagtgagccgagatcacgccactgcaccccagcctggcaacagagcgagactccgtctcaaaataaataaataaataaataataaactgccaacctttctttacagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtacatcataattgatggcagaaaaaaacattctcttgtgtgtgattgtagtccccattgtatttcatgattgaggcaattactgcttatagtcaggggtgatattcaaaatatttggcatctagaacagtgaggcaccatagaatcaagccgggtgccatggctcacacctgtaatcccagcactttgggaggccaaggcaagtggatcactggaggtcaggagttcaagaccagcctggacaacatggtgaaaccccatctctactaaaaatacaaaaattagccgggcgtggtggcatccacttgtaatcccaactactcaggaggctgaggcaggagaattgcttgaactcgggaggcagaggttgcagtgagccaagattgcaccactgcactccagcctgagcgacagagtaatattccgtctcaaaaaaaaaaaaaaagacgttggtcttggctggtacaggatgtcagaggtcccccttacaccttgcgttaaccctttagcagctgaattttggaatgtggcatgggtggtatccagcagagggttctaggcaattgggagagtaggcaggggtgtcagctacttaacatcacatttcgatattataacaagtgttagaactgcactgctgtatatagtggtgctgagtatcattcctgtttctagtgttttctgtccacctatttagagggattgggggctacaaacacccaaggaaaccaagtctcgctttttaattttcatagtcttccctttacaagtgtactgcacatggttctatgaggacttgactctaactggtcactaacttggtgtgtctgctgctacagtctccctggggtctgcagtcatcttgcacttttcaactatttctttgcatccttaaaatgtttcctttccttcttggaggcctcctctccttattacacttccttttttttctttttttttgagatggagtctcgctctgtcacccagggttgagtgcattggtgcgatcttggctcactgcagcctccgcctcccgggttcaagatactcccctgcctcagtctcccaggtagctaggattacaggcgcctgccaccacacccggctaatttttgtatttttagtagagacagggctgcgccatgttggccaggctggtcttaaactcctgacctcaggtgatcctcccgactcggcctcccaaagtgttgggattacaggtgtgagccgccgtgcccagcctatacttcctttctttaatttagtagcaaccagaggaatagaagtagaagctattttgcatagagatgccgcaggtcaggtccttacagaaccctgcgttttaattattaggctggtgcaaaagtaattgtggtttttatctttttttaaaaaaaaaatggcacatactgcaattacttttgcaccaacttaatagatgtgttttccatctcattatactagctccagacatttattcttatcttccacttgattttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggtaaaactgctgctcactgcttttggcttgggctttatttggagatgagggcatttcatttcttttagtgctcgaatattcttaaggctgccgtaagtcaaatgaattgccgaaatgctgcagttcatttttaaatgcagcctaatgatactggtgatgataaataacagtaactgacagttacatagtatttatatttaccaattgccaagcactatcctaagcagttacaaatgttaactctaatcctctcaacaaccctgagaggaaggaactattattatcccattttacagatgaagccatggaggcgcagagagacgttaagtgacttgcttggggacacacggcttaaatggcttaatgctatgttctctttaaagattcacaaaatcctgttgtgtcaatctgtgcgctttagctcagtatttagagcattgtattgtagaacaagctctgtttctctgattgtgatcccttgggaaagtcactttcctccttgtccctcgatttctgacctatattgtaagataaacaatgtggactgaatattccttagtgttccttctagctctaaaactctgacaatatctcatttacccttgccatcttgatgtgccaggatccttccctggagaacctctctctgatcagctacgtcatatcatcgagtgttgcaaacctgaccgtcaggaacttgacaagaaacgtgacagtcacattaaagcacatcaacccgagccaggtggggagaggccagtgccgtctgttcattgaccaggaacaccttgtacaaactatgcttgtaaggcatggccggcaaaaggcagatcaggcagaaagaaccttcagctcagctggagtagtttgcaggactagaatcacatctctccattggattttaacacacttaataattgaccagggcaggtgcagtggttcatgctgtcatcccagcactttgagaggctgaggcgggcagattgtctgagctcaggagtttgagaccagcctgggcaacatggcaaaaccccatctttgcaaaagatacaaaaattagctgggcgtggtggcaggctcctgtaattccagctacttggagggctgaggcgggaggatcacgagcccgggagctcaaggctgcagtgagctatgttggggccactgcattccagcttgggtgacaaagtgagaccctgtctcaaaaaaaaaaaaaaaaaaaaaaattgaccacctaatttccaggaagaattggtgcaaaagcaagctcttaacaactgtgaaatatcagatatcagtgtgtgtggatctgtggctgcaggtctgattctcagctcagttcacactaagcatcatctacgacctcactactcacagtgtggtccacagacccacagcatcagcatcacctgggagtttgctagaaatgcagagtctcaggccctaacccagacccactgagtcagaatgtgcattttcacaaggccccaaagtgattcctatgcacgattgatgagcttaagaagtgctggtctatttagggcttacttgcttctagggaccatataaaataagaactctctaaaaattaagcctaagattctgaaatttaaaaaaaaccacagttttttttcttttcaaatacctttcagttttgctttttttttttttagttcagtaaattaattatgtgtgatttatctttctaccacaggatgagttaacagtgagatgtgtattttgggacttgggcagaaatggtaagttccagtcataaccttttcaaactcttgagtgggttaattggggagggtgtgaagtcactggtgctgtggccttgctgatgggacagatgttcttcccaatgccaacaggtggcagaggaggctggtcagacaatggctgctctgtcaaagacaggagattgaatgaaaccatctgtacctgtagccatctaacaagcttcggcgttctgctggtaatatgcctgtgccacgtggccttaaattctgagtctgaggggtagctgggcatcacactacaatgtctaatctgatggatggataaccgtgacagatcagcagatatgatattgtggctgatttatacaccaatgagattgctctttgctgggcatggtggctcacgcctgtaatcccagcactttgggaggccaaggtgggtggatcacttgaggtcaggagttcgagaccagcctggccaacatggcgaaaccccgtctctactaaaaatacaaaattagctgggtgtggtggtgcgtacctgtagtcccagctactcaggaggctgaggcaggataatcgcttgatcctgggaggcagaggttgcagtaagccgaaatcacaccattgtactccagtctgggcaacagagagagacgccatctcaaaaaaaaaaaaaaaaagagagagagattcctcttctaataagcaaatgcacctgaaggaaaatacctgaacatgaaagacaagtattttttcacattctctttttacatttaagtttttctcttttaaataattaagagaactaaggaattcagattaggatgagtaataaaaattgtttagtttgcaatgcactttaagatttttacaaaacactttgacataaatgctcttatttaatcatcccaacagtcctgcaagataggtagaatggggagttgctattgtcattttattaaaatcagaattaagactctcttgttagatagttgcccacagtcatagaactaagaaatgtaagaggcaggagctaaattgcagtctttaggctcctagtccagttcctttccattgcactataatgcagtgatcaagtatgtgggctttggagtgtgccagacctgaatttgaatcttggcttctccactttctatctgtgtgtccttgagcaagttacttaacctctctgtgtctgtctctgtttccttatctttacctgatagtaataattgtgcctacctcataggtttgttgaatagactatgaatggatccctagaatacttgatacatcataagtcttgtatttatttaaaaatatttgattattaaaagcaatatttcattttccaggacctatctaggacatctgtgctgcctgctcaaatgatggctctgacgttcattacatatattggttgtgggctttcatcaatttttctgtcagtgactcttgtaacctacatagcttttgagtgagtatccacaaccggaaatttggatttaggactcagcactcacctccattgccaacatttattaactaagccctttcctcggcctgccttaccctgtacacccagctagtggagcatccatgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaatagatattcagtgagtgtagctctgcagcaagaatgccattctaaaaaacagcctttccttcttggcttaccagacaggtccctttggttgctttttgggggtaattccaacaaattctaatggaaaagaaggacatgggcatttttattgcattaacgaatcgaaacaatatgtaggttcttggatttagattttggacactgatcaggaaatgtaaaaatttattttcagtgccaaagttagggtctagctgtgactacggatcttctagtgagcctttggaaatattattagtgagactaaataaccagaaggccagccattactcagaatgatttcatcggatctaattttgcatgcataaacatgaacatgtcatcaattagctggcttctcctatgctattacatttagctgtagtttaaactcttctttccatgatctcattttacctaataacatacaataatatgggaatcttggttaaattttgaagatctgaatatagcagactccatgagaagcagcaccaatgcttccgaaagtagtctgggagaaatagggcgagtgcttagtagagtctactacaaactatttaaaagtatgcgtcaacagtcagcatgtaaaaggtcccacagaaatacagacacaaattctccttatggttatcacagatgattctgtttagatttttcctttgttgttgttggttttaagctcccccccaccccatatacacatatactcaaacagaggaaatttatgcatatagacatttaccaaagaataaaaataaattgcttaaaactcaaagagcctgacagatatgcttacataagggttggtgctaggtgtggtaactcatgcctgtaatcccaacactttgggaagccagggcagcaggattgcttgagcccaggagtttgaggccagcctaggcaacatggcgaaaccgtgtctctacaaaaaaaataagggtgtggtagagagcgcctgtagtcccagccactcaggagactgaggtgggaagatcgcttgagcccaggaggcagaggttgcagtgacctgagatcacgctactgcactccagcctgggtgacagagccagaccttatcttaaaccaaaaaaaagttggagggttggcagagtagaatgctcattcttgttctcatcctttccttttagaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggtatgtataagcttgcctgcatgttgcctggactttctctgccttttctctagtgttttgatttttgagcaggtggaaacgatgaagcagatcacattcagcaagtttctaaaacagctttatactcttacatgtgcactgcccgaagagcaactttgtcaagtctccttctaggacacctgtttatttctttggatttgttatgaatatggaattcctcaaggttgaaccatgaatcctctttgtatctccaggaactagaatttggggctggcacagaaggtgctcaatatattgaaaacattagcttggggtggtaatatattgaaaacattagcttggtggtaaagagcccaaactctcagtccctgagctcccagccagcctcattctactttgtacctcccagatatcagacacgtatgacagtatgctaagaagggcagagtgagagaatgtacatataaaacccattgtaacttcactgccacgtgggcatgacatttcagattgtgcagcctattggtggcaggtcgcaaggccttaggctccccaaatatgttgaagatttcttcattcaatttcccacccaatgcaggagcctcttcaaccctcaactccacctgacttatccttgactaaagataatctaacttctgcttgaatacttctattactggggagttcatgaccttacaaggcagccaataaccattttataaagctctacagttctgattttccattaagttcagttggctccctggtggcacttaccagtggttttgctcaggcagaaaacagtaagttgatacctcttctgccagagagtcctttagataatctacaagtaatatataacagtgtgtataatcccctgtttttcacacaagtgaccccatgcaagataagccagtgaggtgagccaggcagtcatcccaaatgtaggtgaagaaactggctccaagtgatgatgtgatatccccccaattcacaaagctagaaaacagcaagcctggctctccgtctccttatatgcagccttctgccatccccccaaccagactgcctctattttcaggctaaatattcctacacatcaagattgaaagcacaccaccacccttgccaccctgccttctatcttatgtcactatgtctttgtgaagaacaacagaacaacaccctttccctgtttgtcccagaaacataagtcaacgctccagatactgggcacggattctgtcttctttagagaaggctgaaagtcagattcctttcttaagtatgaggcccccacccccaatgttttatttttaacaaagtgtctcacttagaaaattatcatatgtcagggtcaccagaaggtacaagcgcaaaggcattaaatgaactattagatttgattttaccaggcactgcaactggtctgtgacaaggaattgtttgttctttaccagagccttgagataggacgtctgctggtcagtgtgcagagtgtggggcggtggcatggggctggcgggtgatggtgtgcagtggtgaataggattctttccccaccaaaagccattttaaacttgggggacccttctcatggtaccttctctgaagggaagtgtccgtgggctctcaacagagccagcatagtagcagtcaccaccccctggatcagccaggacagaaccctccatccttcactgggtctcaaagtcttcaaattgaggacttttggtttcataatgaaagatttgccaggagttgctgactcttaaatatacattccagacatgtataagttaaaggcacaacgctgggtgcagtggctcatgcctgtaatcccagcactttgggaggccgaggtgggcggatcacctgaggtcaggagttcgagaccagcctagccaacatggtgaaaccccgtctctactaaaaatacaaaaattagccaggtgtggtggtgcacacctgtaatcccagctacttgggaggctgaggcacaagaatcgcttgaacccgggaggcggaggcggaggttgcagtgagccgagattgtgccactgcactctagcctgggtgacagaggggggccgggtggggggtggggagttaaaggcaacactggcagctgtaacagattcaccttgaaatctcagtagaagatcatttctcactcacctacagtctagttagcaggggcagaggagtccctggtcttgcagttattcagggatccaagctattgaagactctgcctcaaggttgccctaagtttgcaggcaaaaagaaagtagaggatctcacaggaggtttctatggggcaggcctggaagtggagcaaatcacttgtgcccgtatcccatgggcccaaagtgagccatgtggccacacacacccagctgcctgggaggctgggagcatccagtcatgtgccaaagaggaaaagaaaccagcctggtgaacagctagccagtctctgctacaagatgtaaataggatgtgatctctagtcttgtcacccactttggttattagaactaggtgtgaccagccgggtgcggtggctcacgcctgcaatcccagcactttgggagaccgaggcgggcagatcacgaggtcaggagatcgagaccatcctggctaacatggtgaaaccccgtctctacgaaaaatacaaaacaaaaattagccaggcatggtggcacgcgcctgtaatcccagctactagggaggctgaggcaggagaatcacttgaacccaggaggcggaggttgcagtgagccgagatcgcaccactgcactccagcctgggtgacagagcaagaatccgtctcaaaaaaaaaaaaaaaaaaaattaggtgtgaccaatgtttcccatcttccaggggtaccagctgtggttgtgaccatcatcctgactatatccccagataactatgggcttggatcctatgggaaattccccaatggttcaccggatgacttgtgagtacaaagccccctaagggaatgctaagtgaactggaaaacggaatgctcctagaaaacggaggatctaatcagcatattgactcctgctatcatcctaataaaacccagcaatacttcacagcagccttcacagtcatatgtaatgagagaagctagctggaaatgccatgctactcttcaagtgatgaattaggagctattctgaaaagaaaaatgaattaggaagaactattttgaaaatattttcattagcctctgataaaatgacattccagttatattaataaagactcatagaacagagttgctaggatttacaggggcaaaatcctgaatgtttaaaaaaaggtctatttttaaaatactttaaatcaccaagtgtcctcaaataaactcttagattattttccctagagctataaatggttgtagagaatagcagttttatcattttttttctcttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagagatgttgggggtttggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaaaaaaaaaaaaaaaaaaaagtactatctgtgaaaccccatgaggtatgcttgtatatgcaaagtagcttatttagtggcttatgatattttcattgaaaaacatatttattattgagagggagtgctttgagatccttggaggaaaggtgcttactaaattcaagaaatggtgtttttttctccttattcatagttgtctccttggagagaccatattgaggggaacctgccaggaacactttttgaaaaagtcaattattcttccttcacttggtttcttttaaaaaaaaaaacttttgtattcaagtagaacatgcagactgtaagcacacataccatgactgtgcctgtgggagctcaccactctcccctcctaggtcagcgatttggagacaatgagaaatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgctgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctgtttctctcctaatgcaaccaatggtcgacttccagggtgacaaatgaatgaagctgtgtaatattcagacatgggtcttgacggtgggcacatataccctactagaagcaaaactgttttgtttgtttgttttttgagatggagtctcgctctgtcacccaggctggagtgcagtggagcgatctcggctcactgcaacctccgcctcccgggttcaagtgatcctcccacttcaccctcctaaagtgctgagattacaggcgtgagccaccaccacgcctggcccctggtatcttaaaatgaaggttttaaagtgaatagattgggggtttttaagtagaaagcagagaacccagaattcatccattcactcagcaaatatttattggcaaaagccttggggagtggcagccatggggctggctggggagccctggcctgccttgactgggcacctgagtgggtgagaggtggagtcccagggccccttcaggtcttcagcttgctctccatgccagcacctggggcaggtcaggaggaggcaggcaggtaggtgagtgcattgctgtactgcctgggtttgagggggagagagagatccaagcaaaggacatggcagtgggctggagaggaggagagtgggaagggaaagatgtgtggaggagatggcatttgacagagcttggaaacggattctaaatagggagggagggagaggcaggagcctaagtccaagctgggatcctgggtggatggcttgtaattccaagatacggaaggccaaggacaggatgtgggaggagacagtgaatttaattgtggaaatgcaaagttatgattccttttatcatataaatattcttaatcttacaaagattttctaaaggcattcattccccgatgccttttgacagcaagctttcctaggactctgaactttttattcaatttgcaaaatttcatgttgcccacagctgccaaaataattattaatatcttttgtgcaaagtgagcttatgacattcagctattagcttggaattcattgtgggttttttttccctccttaggatttttcatattcatcttttactgtgtggccaaagaaaatgtcaggaagcaatggaggcggtatctttgttgtggaaagttacggctggctgaaaattctggtaaagatttacctcactttttctcttcctcttaaatctcaaggaaaagattgtataaattaagatccaaagcaaatccaatctagaaatcagtgaattccagcaaatctggaatttgctcaacagaaaatattgatcgtgaacattagggagaaaaaaaaatctagtgaattaaaaaataattatttctatctgggaattttttgagcaataaaattgatgggctggctgcctcttcaatgaagcaacagtaaaatttttagaattgattttctattgagattatgcttttcatttcccaaagtaatttttaatatttaccttggtaatttttaaaatctcaactcaatcctttctccacaggtcctggttgtcagttgctttatttgttagtaagccagactttgtgtataagctttagcatacatttggttgtaacatacatttgtttattttgaagtgattttcacatatacccggttgggtagtagagcaaatagctcattttttttttttaagaaaatgagaaaaatgaagtactgtttgaaaagctacattccttttgcatgaataccacctttgcagtatctgggcgacacgggagtctgtattcagaaaatggcagtacacatagttcaatcattttcatggagtgaagaacaattagtcattacaacacagactatttgtgttcttgttaagacagtgtgaggctctgaatcactacctaattctatggatatttatagacataatcaaattagcttggcctttagttctaggagaatataggttacttttaaccccacagtcatttgaaggacaaatgtaaataatccaaatgaaaatacatgttatcacaccaactggtggaaggtgacttctccataagatcctgaagtgagaaatcagttgcttaggacttgttacactgtgatctgtctcttgcgtttgagcttcaacatactgccctgtttttctgtaatgcttattctgctgtagactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggtatgtatgtctcaatatagtatttctcaagctagtgtttattttttaaaatagttttatcctttattggcattttggctaagcaaagtgagtaactattaatacatatatgactagtggatcaaaatgtggttcccttacagaagagaaagtttactaatccaaattgatttattatagagcaaatactggaacaacgattttttaagatttggtttttcatagtgggaattgatgatgacctaaaaattttaacattttaaatcctcacttaactattgtccaaagacttcagtattgtgctatttctgtgagagcagtacctaaaatagctgataagactatagcaatttttattacatctatcataatatacatgttcaacattttttttttttgagatggagtctcactcttgttgcccaggctggagtgcaatggtgcaatctcagctcactgcaacctccacctcctgggttccagcaattctgcctcagcctcccgagtagctggaattacaggtgacctacaggtgaccgccacgatgcccagctaatttttgtatttttagtagagacaggtttcaccatgttggccaggctagtctcgagctcctgaccacaagtgatttgcccacctcggcctcccaaagtgctgggattacaggtgtgagccaccgcgcccagccaacacttttaaaccttcctattttttgcttttcatgtttgttaattctttcccacaatgtggctgtcttgtgacagcacccaaatccccatgaatatgtcaaaatactggaagatgacttgtgaccagtattggtgaccatatatgtgaccaatatctgaacagattattgctgccatgcctcctttactcattaattctgacatttctagctaaaacttctgttacattttctttctttcataagaccaggctgttcattactcataaaagcttaccttatctatttttaccttctcttgcttcttaatatatcttttgcattcttataaaaacataagctctgctggtatagtttctccttccatggagaatttgcctgtattcattgttttaggatgttagttcttttcatgactaactcaaataaatttgtgagaaggttcatacatctaccagttttcccgtttcctgaagatgggcagtcctgctggtgtgtctagacttttttttttttttttctttttttttatgacaaggtctcctattgcccaggctggagttcagtggtatgatcacggttcactgcagcctcgacctcccaggctcaagtgatcctcccacctcagccacccgagtagctgggactgtaggagcatgccaccatggctggctaatttttttttttttttaagatgcagtcttgctgtgttgtccaggttggtctcaaactcctgggctcaagtgatcctcccgcctcagcctcccaaagtgctgggattacaggtgtgagccactgtgcccggcctgtctaggcttttaaaataccataggatgcctcaaaatcaaggtttctcaacttcaagcacaattgacattttggggctggataattcttttttgtggaattgcaggacatttagcaggatccctggactctatcaactagagccagtagcaccctgcccccagttatgacaacccaaaatgtccccagacactgccaactgtcccaggggagcggggagaagaagggagcaagattgcccccagttgagaatcactgctgtaaaagatgagaaataactgttgtatagccttagctctttactgtcgataccagaaagcaagctctgggctctacaccaaatagctctatcaggaatgattcaatgtaggtaaacagaggcgaggcagcggggagcacagctggttagtacgttagtgtgagaaagcaaattgaaaggagagacatcaaaggagcgagcagggtcatctggggctctgaatccataaaccagatttgtccatattctcgaaagagctcagagatgaagcctcacctgcctagctctatcaacatgttgtcatcctttgggaaatcagatttcatggaaacagcacattttaccacagttgtttaacacagctgatttgacacagctacttttgatgcttgacggtgaggatgggggtacattttaaggctgccaaaatggctcagtgtttaatatcacataatatgcatgtcagataaccattcctgactcctcagtccttgccccagcatctgggatagatgaggaatggaattggcaatttcaaaaaagaaagctagggctgggcgcagtggctcacacctgtaatcccagcactttgggaggctaagttaggaggatcacctgaggtcaggagttcaagaccagcctggccaacatggaaaaactccatctctaataaaaaatgtgaaaatcaaccagacgtggtggcacacacctgtagtcccagctactcaggaagctgaggcaggagaatcgcttgaacccaggagacagaagttgcagtgagcctagatctcaccactgcactccagcatgggcgacagaacgagactccgtctcaacaacaacaaaaaaagctagaagtttaatgatttattatgccagaccaaattgttcttgcaccaaaatgtcctcaagccgaaatgcctaaatccaaacagctgcctcagacagtcacatgccctatttgatctgtgtcacagatggagctacgttaaccatattcatcacctagtttgcatgaatattacacagttcagttctgagctgccttagagggtggggtaccagcagccatctcatttggtacccaggaccacaaggatcacagtttggaagcaacatcacacgtcaactccattacttctgagctgtgtgaccttggggagagcacttaatttctgaaaccttcgtttcctcatctgcaaaatggggataacagtagtacccaccctgcagggctctaaatgagataataaagtgtcccagtactgttatgatcattgttatcataatcatgtcatgaactatcaaatgggcttattattcagctttgtgtatagtctcccaatggtctaatgatcagaaggatggtgccaagtaactagaggaggccagcacctgtgctcccctataactcagggcctgcttggggtggggaaggcccacgtccaaaccaacagttacccttgagtgcccagctgctccctggcctggactctgaagttggaattggtagtttcctcttgggaatttgtcctgtcctgatttagtcagaggagctggtttaatctacaagagagatgatttcttcttgccatgactgttgtagctggttgctctggtttctctggtacaaagtttcattttataggaacctagggaaccaagaacttcctaagggtacatatggggatctctgttaacattaaccttttgggagaccaaagtattaccttagcttatattatacatatgctgctacttgaagtcaaaacatatccaaccagagttaggaagtgggccttttattaatatattaccttgcttcagattttgactgtttcattaaaaaccaaacaaaaaaaaaactgccatagagaactggtttctgaagcaatctccactttggtatgcttactttgagtggccttagggaagtaatgaaaaataaataaaatatgaacatatatcacaaatgtttttaaaaacatattttacaaatacatctttaagaataaagcaatgtctaagtttgtttgctttttaatgctttctgtggatacttcatgccacccgctttgtgtttccttatacaggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaa

SEQ ID NO: 3177 - DNA, 133328 bp, human; identical to SEQ ID NO: 3174

SEQ ID NO: 3178 - DNA, 133245 bp, human; identical to SEQ ID NO: 3173

SEQ ID NO: 3179 - DNA, 133245 bp, human; identical to SEQ ID NO: 3173

SEQ ID NO: 3180 - DNA, 133328 bp, human; identical to SEQ ID NO: 3174

SEQ ID NO: 3181 - DNA, 92733 bp, human; identical to SEQ ID NO: 3170

SEQ ID NO: 3182 - DNA, 40399 bp, human; identical to SEQ ID NO: 3171

SEQ ID NO: 3183 - DNA, 16820 bp, human
cactggtaaaaatgtattatgcatccacagggctatatattaaaatcagtattaatgttggaaatgtcatatcccttagggacgttcattataatagagaaaaaagggacaaaatattaaacaacatagatgagtttattcaaatctaatggttacgggagtgttgctaagtgtttagacatgtaacttgcatttgaatcaatgaacatttgctccggaattgtctccaggggttggagaatggagtagtgagaggatgggtagcaaaaacatttagtagtgtcagttggcttttgcaaaactaacttctcccagatttggggaaaagggaaatgtttaaggaacctaggaagacacacatgtttgtaaaccatgccagtagttatgctaatttttattattttatttcagatgttactttaagcttactcccttcaaacgaaacaggtaatatcaagtgatttctaaatgtaatagcttcttctgcagcctcttgagtgtcttgcttgtgcagtctactgggttactaaagagttttcttttgcctccttgccctttttcctgtgccttcaaccattgatttatgacccctttgactttgacattgaactataattctgtcaccacactcccaaacttccaaaggatggccatagcactccatttaaaatagcatgtattatttttgtgattataatagtgatacatattagctcataaagatggagaatatagagaaatgcaaagaagaaaatacaaatcatctttaatgttactttcctaagactatgactgttaacaatttggtctatttccattcagtatcatttatacatatatttatatacatatactcttatatcctttgcaaaatagtcataatttacatagatttttgtatcttgcccatttgacttaatattacgttagaagtatattccagtgtcccttactattatgacttgataatattccattttgtaccatatgttgaactttaaagttgtttctatctttttaatagaagttattgcaatgaacattctggtgccaacatctttgcattcatttcttatttctgtaagatacattctaaggattgcagtatgcaaggattgcattctaagggtcagcagtatgaatattgtaagactcttgatactactgcttggttaccttctagaaaggtcgtgcctagcgacattcctgtccgcagtggatgagaatgtctgtcactgtacctttgctgagactgtatcatatcttattaaatctttctctcaacgcttaggttttatttttcattcatgattactagtgaagttaaacatttttaccccagagcactttagttaccaaaaccagaagttcatttcacagttgtattttgtttgctctgaaaaggaaactatcagggcaaacaaaataatatatttaaaagatttttttttttttgagacggagtctctctctgtcatccaggctggagtgcagtggcgccttcttggctcactgcaagctccgcctcccgggttcacgccattctcctgccttagcctcccgagtagctgggactacaggtgcccgccaccacgcctggctaattttttgtatttttagtagagatggggtttcactgtgttagccaggatagtctcgatctcctgaccttgtgatccgcccgcctcagcctcccaaagtgctgggattacaggcgtgagccacggcacccggacctaaaagattcttaatgacaatgtgaaatgctatcagccttcataattaccacccatcattggctcatgggtcacacattgaaacctgacagtttcagaaacctcatttgtgtgtctttgttactgatgagtttctgccaggataacatcatcattcttaagtgtgtttccaatctctgagcttggccttttcttcagaatttgcccatccaccctaggtgacagagcttcggtgaaaatctatgccctgaacacagcctctttccattggccatttttacagcaaagatttctgtacctgcttctccgttacctggggaatgaaccatgggctctgtccccaaaacgtgtttggaagacatttctaaagtttgcttcttcagggcatgttaatatttgcctgtgagtcactcactttgaacagtcttggttctgctgtgggcgtgttatgtgattgtgtataggtggatgatctcgacctctctgagaatagcattctctatcagtacaatggggatagtattatgttaactcctaaagaagatagcgagacacttgattgtataatagcaatactttacatcccatgtgtactgtttcacattaatttttattctgaattacctgtttttacaacctatcacctgaaggtcccgatagtggcttaattctacatatctgaagtgtaagtccacatcatttgtctagcagcagtgtgtggaaagtaaagtagaattacacaggcagtggggtgtgtaatgggtgtgatctaactgcgtaaacatggaactccaactcccagactcaccctgtgccaatgctacatgatccgtggatgcggttcctattcattctgctgctgagatgaccgatagtgtcttaaaggtgtcaacagtgtgactttttttttagcacttcactaaaatgatactcatggcaaattgtttttaaaaaacaagcaatgattattctctaatatttaagttgtttctttgcagaaaaaactaaaatcactatagtaaaaaccttcaatgcatcaggtatgacttattatcaatatcaagactttcctttttataactaaagtaaaattaaacaaatggctggtgtttataatttctttctcttttttccaaacttttcaagataaaatctggtcttaacaaacagatgtgtatgcactgggtacctgaaattgtactaggtgtttggggctatataataatgatcagacacagagcctaccctcaagaatcttctagtctatgggtggagacaaggcaaaaaaatagataactaacatgaacatgcatgcagataaaggcaatgattatacaagtattactgacatggttaagaggcataggagtagagggggatgcaattaatgaagaagttagaggaatgaacctcaaatttttttttcctgagacaagatctcactcagtggcccaggctacagtgcagtgatgcaatcatagctcactgcagcctcaacctccttggctcaggtgatcctcccacctcagcctcctgagtagctgggactgcaggcttgtgccatcaagcacggctaatttttgtattttttgtagagacaggatttcgccacgttgcccaggctggtctcaaactcctgggctcaagtgatctgcctgcctcggcctcccagagtgctaggattacaggcctgagccactgcacctggccaaattctttttaaatcaaagaaaatgtgtacttttaagtttctgatacaagactacacacacaagacatgcttgacaaaggcttgatttcaagtagcggttggcaaactatcaccaatgggccaaatcgggctcactgcctgtttttgtgaataaagttttattggaacactaccatgcccctttgcttacatattctctatagctatttttctgctgcgtaaaacacgagtggttgcaacagagaccatatgacccacaaagcttaaatatttactatctgaccctttagaaagttttctcactcatgatttaaggaatgacctgtggccatgtacatagaggagattacagatgagaatgctagcagtaggaaaaacaaaattctcagtatgaatgaacagcaagaagacacgcatcactggaaacggagctgcagctaaaatttagaaaaagatgagatgatcgaatgaaaagtttagtaagtaatacagcaatggtttaaaggacatttacagcataactacccattataaaatctataaattctatatttgcataatatatatgttatagtgagttctatctataagcaagtatatttgcttatagacagaagaagaaatgaaatatttctcttttggtgtgggtaacactgctttggaacaatataaaaatctacagatctggtaatttggggtacctaaatttaatttgctcacaaaatcaaaactcatagctataggtgtcttcgctaaagcatgatgcctgtacatcaataaatcacactagcagaaagcatatcacatgcactaactcaaattataattttagtttgtacccaaactagttttctcatagaaaagaatttaaggatttgtaatgtgcaatggaaataaacttgcagttgggcattgcacacataattctgaccaaacaagacctaacaaggagacaaaaatatttcttaatataacaagtttttcccttggcagtttgtttaatacattatcagcatttgctcctcccatgtactatggatttcttatgctttgccaaaaggatgcaattaataaaggaaggctttttagagaagtaaaccttgagttcttttcaaattgaagaagagatacacttctcctctcaccaaaggagaaagtgtttctcaggttaatacgtataaagttttggttctgatgctcattttatctcccagtcatctctgtctcctttgtatgcctgtgtggtctgttgtcctggtcatcactccattttgccctcactaataagtaaattaaaaaatgctttttatttactggctagtatcatccactagattgtatgctccttgagggcaggatctatatctggaaactcccaaagcctgtagaatatggttaatgctcagcaaatatgttttgaattttgtagtttttgcccatgaaacaatattatgacattaatgttatttcatacatacatttgcataaagagctaggattaacattagagtgttcatagactcccctacataggaaaagaaggaggatctatgattaagggccattccatttaaagtctctacttggtttgtgttcatggtgctctgtttatactgaacaggagagggattaattgggaaggggtcaaaaattttagggaggagttaaggatcagatattgacatactaaagattagtaaagaattaagttccgtagctgacaaatgaccaacaaatgaaaactcatttctttagtctttgtggaattcatccatccaattaattccagcttataatatttctggtccacatttgatgcctacgtttatgaattctcttgacaatgcagcacataaacacgggcattgacatgcttaaccagctgggttgtgttttctttgcaggcgtcaaaccccagagaaatatctgcaatttgtcatctatttgcaatgactcaggttagttcttgtgtacattacacattaccagataaatttcctccatagagataaatggttcactttcttttcttttgagtatgtggtatgtgcctcttggagctgcctcttttcatgccacctggctactaggagtccctaataaaaacaaaagcaaattttatatctggctgaaattatcttcccgttgcctagtgagaagatggattaacttccttaatatgagacataaagctctacaataaatatttttcattatagctttaaatccataactaatacccttagaattaatttgtgaacataactaataaagacattaataattattgaaagtcacttcttatatagaaatctgtcaagcttttccatagggccttaagtattagagcttagaaacaggataacgtcttgctaagaataaagcggatcagcctgttgaatgttgaaaactcaagtacacctagtttaagtggatgctaattccagtagtgtccatagtgtattttgccatttctaactaagaccatttgctatttttaaaaattgagatggaaatcccttgagaacatgctatttttgaaatgggaatattttcccttctgccatgggccagacggaatgaaacaaccacttttctcaccttggtttggctctctgggctcccttccttgttaaaaccaatgaaagcaaatgtgaaaaacagaaaaatattgtgtggcagatcagaattggccagagatcatgagaagcgagaagaggaagttaactaggtattttatgttctgaaagtcttattgtgattatagtaataagcaatcattacaggaatattttctttattccattccttttaacagtttaataatttgtttgaaaaacataggtaacaatttcaagtaaaataaggttggataaattagaaaacaagaaaatgtcctattgaaagaatgtttcacaaacactttctattgtgtgaatataagatttgctcatttttctgctgatactacgttccaggtagaatataggaggaaaatattagctggttttgattaaagaaagcaaagtgttggatacatttcattttcgtatattgtataactctcttctcttttcctcctccttctctccctcctctctgactcttccgttcaccgaattccccataatgtcattatttttgtgcttcacttatgttttgggctggtgactaatgtctagttcagtgttgtgtctacatgatgtttgataactgtttgaaaattgaacatgtagttaaaaaaaaaaaaactggtcatcttgagtaacagatgccagaaagctggttggagtaatgttttccccaattaagggactgaattgaccgtttgttttagtgtcggtgacaacaacctcatcagggtttttggcaccagaaaccccatggtaccctgccagaaactagaaaccttcacttcttgcaggttccaatctgggttcattaaggaaaatggaggctggtgaagaaagtgggagctgaccaagagtcaggctgatagtcaaaaggtgctggcttcctggttgctctgctaccactgtgctcccagcacatttatgaaactcaatattcatcaataagaatgtgaggcagagacgttgtgggtgttggcatgcacgtacacacacaatttaaataatcatttaaaagctaagatttttaaaaatggataagtctatgtagatctcaaatatcttttaataattacatactgtatgaattgaaatttcagtatcgatatgtggaaactgaggttcttagtagaaaagttgctgaaatagatcatgtcaaacactggtctagtgccttcttggccatttttaagcaggaataagttgttgtactttggggtacaataaaagatgatgagaagaggaggccttctagctcaggggttggcaaactaccagccatagtccaaatatggcctgtttttgtaaataaagttttattggaacacagcccatgcctgttcatttacgtattgcctatggctgctttcatgctacaatggcagagttgggtagttacagcatagatcatatggcctgcaaaccctcaaatattgactacctgctcaatcaccaaaaacgttggctgagccctggctctagtttatgtgatatccttgccccattgctcacaaggccagtttgctcacgagatcaagcttgttcaactgcggcccatgggccacatgcggcgcaggacagctttgaatgtggcccaacacaaactcataaactttcataaaacattatgagacttatgcatggccttttttttttttagctcatcagttgtcgttagagtattttatatgtggcccaagacaattcttctttcaatgtgactcagggaagccaaaagagtggacacccctgcatatagattatgaagtgcacaccacgtctttctgtttaggagtctctattttatttgtttccagatagagtcaaagtccccaggaataaaatttcttaacaaggggacaagttttctctttctgaattcccacataaaatttacagttcatattttctgaaaattatattgataatagttgagtaacttactgacaaagtaaatgtgaataaaaacaatttgatgaaactttataatttgataatctttttgtatgtggtattaatcctcaagctataaggatacaagtctcaaatatctttttgaaaatttatttttagcattttttagaggtgagatcatgtttcaatatgataaagaaagcactgttccccaggtaagttttaaagattttttttactgcaatcttaaaaggcaaattcatttatatttaaacatttgtttgaggttcagattatttatgatatttggtatatttattgttatgaccaaatttaaatgaaatatgttaattgagtccctagctttgtagcgagggcttgaattcataataatcatggtattttgttaataactatattttagttttcaataggcttgctgctgaataagaatgttaaggtgatgcaattctactgccagttaaaattttaaattatattagaaactcctagcaacaagaaatatgtgtattgaatctatgaataatattctgaatgtgattctctttgccccatgggggattctgatgcagtggtatcagccttcccaaaacctagattggttcagaggatggccaaatgtggttcattcattcgatgactatttctgagcacctactatgtgccaggcaatgagctcattgctagaaatacagcaatggctgctatcaagttttcctttttacattggggtctgttacttagatccgggacctttcgtgacaagaatgttaatagtgttctttgtgaggaactcgtgaaataaagaaagacagaaatcagcacatcagagctgctgacttagaatattttttaaagaaaacatgaaacaaaaacaggctcagccaatatggattaacttttaagaaccactttttgccctcccttttctataaaactgcagcttgatcatttagatagacaatgttccttacagttaggattcagtctttggggtatagttatttgagtggctgataaaactgaagaacaacttactgttagagagtgaaaaaacaaaacaatgtttgttatattcttaatgattttatgcttctaacagaatcaacatataacgaatggcaccttaactggagtcctgtctctaagtgaattaaagtgagtaatctgccgtttgatttgaaactgcagacatcaactatggaaggatactttttgagccatgtttgcaattgaaaactgagaatgggaaagagaccagcccaaaggttatagagccaattggttcttgacttccttgcagattaaccataatcacatcaactattatccccatgaggctctttgatgcgctgaagttatataacagcttcatttgaattagcatttgagttttaatatgatttgatatccagcatggttgaaagaggagtccaaggtgggactccaaatatatgatttgttgatgctttcatgaagcatcagtgattcataagtcagagaaaagtctttgttaagtagacctgggcttagaaggacaagcacagacaatgagaaatgcattacaaacagatgccccttggccgggtgcggtggctaacccctgtaatcccagcacttttggaggccgaggcaggtggatcacctgaaggcaggagttcaagactagcctggcgaacatggtgaaatcccatctctactaaaaatacaaaaattagccgggcgtggtggtgggcgcctgtaatcccagctactcgggaggctgaggcggaagaattgcttaaacctgggaggcagaagttgcagtgagccaagattgcaccattgcactccagcctgggtgacaagagcgaaactctgtctcaaaaaaaaaaaaaaaaagtgcccccagttaaacagtaagtcaaaatgtcagccaccaggatggcctaggccaggagatgatcttactgtgtccgtcaccaaaagggtcaacttcacgtttatgccctcatagcagccagtgaagcagcatcagagacaaaattcatctactctcaacattgctactgcctcacaaatgagattgttataaacttttgaagcaaatctgctgtagtgtctgtgatgacactgaaaagaaaaatctttcatttaaaaacaaaacaaaacaaatccctcttcttatgggtcatctttcaaattagctttttgacctggctacatctaatgattcagcaatgcctaggcagagagaagcatttggcagatagcaaacatccctagggcctactcagtttgtagtggttaagaagttcaactagtaagaactgggagtggggtggggtgttattcatgtcctttatgcctattctttgacctcctgatgaaatctagcttttctaactattcatttatatatgtgaaatgtaaagcagaaaagatcaatgctctggaaggatctgaaactttagctgggcaatagaataattttttttttttgagatggagtctcactttgttgcccaggctggaatacaatggtgccatctcggctcactgcaacctccaccctcctgggttcaagcagttctcgtgcctcagcctcccgagtagctgggattacaggcatgtgcaccacacctggctaatttttgtatttttagtagagacggggttttgccatgttggccaggctggtctcaaactcttgacctcaagtgttctgcccacctcggcctctcaaagtgctaggattataggcatgaaccaccgtgcccagccaaaacttttttttttaactcacaaatttacaattagaatacaacttggcatacttgtaattactcttaattactagactagaaatagaactgagttcatttaaggtcaccaggcatttgttgaacacctactttgtgctcggccttggggatccacagggataaacccaactctctgagataggaaaccaagtctagagcaatgtttctcatccctggttgcatattaaaatcacctgggagctttcaaaaatcccagtgcccaggcatgctccataacaaatcagtatttaggggctgagacccagcattggcatgtttccaacatgaggctaattgtgagaaccagggctctagaatctggtggggaagacacaagatgcaacaaataacaatacagtgcaacccctgcactgaaggtggcttgtatagggtaccaaaggatggatgttctaagtctctgaatgtagagcagcaggagcaattaaaccggactgcagcggagggataggggaacccccagaaagaaggtgacctgtaggtggggcatggtggctcatgactataatcccagcactgtgggaggccgaggcaggtggatctcttgagcccaggagtttgagaccagcctgggtaacatggtgagacgtggtctctacaaaaaattagccaggcatgatggtatgtgcctatagtcccagctactcaggaggctgaggcaggaggatcgcttgagcccaggaggtggtctctgagcacagttacggaggaatggctcctgccagcttgaggagttagcagctattgccatggtccttcccttcttccttccagaccttgcctgatgctaccattccttggagcaggttttctcaaccttggcactcttgacttccagcaggctggatcattctttgttgtgggggtatcccgtgcattgtaaggtgtttaacagcatccctggcctctctctaccagatgccagtagcaccctcctcagcgtaacaaccaaaaatgtctccagacatggccaaatatcccctggagggcagactctcccctgtttgagaactaccgccttagaatgaattctttaactggattcctctcatcccaacttcatgtgaagctctgccactttgaagaaatgaaagcatggttggagtgggattggaggagaggaaagagagaatttcctaagggggagttgtgaggaggggaaggcagcgttggagagggccagagagggcagaccaggtcagtgggagacgggatgaggaagaaatcagaagcacaaggtccccagggtgagtggcctgcccctctcgaaaatttttgcctggggctagctctccctctgaccctctgccagaagaagctgcctgaggctgcagtagcctaatgaataacaaaattgtccaatcataatttataactcacttttggctagaactgacatagctcctgtctggttggtttcccttgtcatataaattatttattttcttgccacataggactctcttattatactctctatttcttcaaagtgaacaccataagcaatgtataccatgtgcttgatttaattgctaaaatctaacatgttttcaatttaatatcactaatggtctccttaatgtcaatttctctcattttattacagacgctcagagctcaacaaaaccctgcaaaccctaagtgaggtaatcatagtgcaccctgtagcttgtttataattattgttatgacctgggggaaagcatagggttctgcattcctgggagatatgtattcaaattctcccaaatttgttgtgtaagagaatgaatggactagtttttttattccaaaaatcagaactagaagcaatgggtagacattataaggaggtagattttccttcatgtaacaccaagagtttcttaaaatataaactccaagaaaatgagcttccttgtgtaatagtgacctcacagagattgtatggcctgaagagcgttgatgatatgccgggaatctggtaggaatgtgaagtggacaatccctaagggctctcgtgattctaaaattctgtgattagccttaggtcttcttttctgatatttccaactgcccaaagtaacatatatgtgtatacgtgttttttgttttgtttcagacttactttataatgtgtgctacagcagaggcccaaaggtcagtcatttttaatactttcataaatataatttctccatttatgagaaataaagtattaaggagtcttagttaaattgcaaatgcaaagggggtcctctaaaataaatacatattaatgacattttggatttaaatatttttatttttctaaacactgatcactctgtcatatccatcttctcatttctttacaaagtacagagaagtgtgtagtatcgggccatttacctccggttccacaaggctaagggtcatcagtgtccttagccccgagggccaccaatataaccaggaaatggctcccagtggtccaggcagggtgaaggccagaacaaaaagagggaatgtaacatggagcttgggaaaagaaggaaagagggggaaggaaaagattggaaagaaagagaaaagaacatggctgggtgtggtggctcacgcctgtaatcccaacactttgggaggctgaggtgggcagatcacttgaagtcaggggttggattccaacctggccaacatggcaaaaccccatctctactaaaaatacaaaaattagccaggcatggtggcgggctcttgtaatcccagctactcaggaggctgaggcacaagaatcacttgagcctgggaggcagaggttgcagtgagccgagattgcgccactgccctccagcatgggtgacagagtgagactttgtctgaaaaaaaaattttttttaaagaaagagaaaagaacaaattaagaagcacatgcacacaggggtgaatcacagcttgtccaacaattatttggggttgcacagattatcattttgaattgtgtccattggctatcctggctgtgtaaaccgatggcttacagggcaatacactcagtatctgaaccccgagccttctgtgacagtcaaagtcctagaaaatgagagtttctactcattaaactattcattggtacaaataagggcaatgaaattgtattccctgtccactgtacgtatttagttcatttcactgacctcttttcgttattgcaacactaattttctttcacctaaaccaaggctaaagtagaaaggacagagagaatgtcttcaattcttagctatctaataatctagatagaattcccagaaagatttttttttttttttgagatggagtctcactctgttgccctggctggagtgcaatggcacgatctcggctcactgcaacttccacctcccaggttcaagtgattctccctgccccagcctcctgagtagctgggattacaggcacccaccaccacacccagctactttttgtatttttagtagagacaggttttcagcatgttggccaggctggtctcaaaatcctggactcaagtgatccacctgcctcggccttccaaagtgctgggattacaggtgtgagccaccgcacccggccccagaaagattttggatttgaaaggtcttgatgtggctgggtgcagtggctcacacttgtaatcccagcactttgggaggccgaggtgggcagatcacctgaggtcaggtgtttgagactagactggccaacatggcaaaaccccatctctaatgaaaatacaaaaattagtggggtgtggtgatacacggctgtaatcccagctactcaggaggctgagggaggagaatcgcttgaacctgggaggcggggaggttgcagtgagctgagatcatgccactgcactccaacctgggcaagagagcgagactccatctaaaacaaaaaaagaaaaaaagatcttgatgttcatctagactggtatgtgaaagggcacccatgatggaaactcaaatgtttatggacaccaggcaagtggccagctagtgttttgggggtgagattaaaggtgtcaaggtgcttgcttgtctctgcaaccaagtttcacccctgcctgttcatcgtgtagacaggcaaaatgagccagcacctatgtgtggtcagagagtctctggtttgcaacctctgtgaatgtgaacctccataaatgtctcttaatataaagtctttttgggtaaaattcagaccgtggtaaatgggtatttacaagcttattggggtgacatcacaagttaacagtatcagtgtcccctttcctcactctaagtttgcaaaagcaattacaaatatgtaagtaggtttcccatttagtaacattctggttatgtatatttctccttacagcacattaaattgtacattcacaataaaactgaataatacaatgaatgcatgtgctgtaatagctgctttggaaagagtaaagattcgaccaatgggtaagttgtctattattgctgcattaatcttcatgtggattttaatgtgttatttttctaattgaaaatgtaattaataaatttacatatgttacagctttctgttttgactcctttgtccttgggcaatttctctctcttttttttttgaggcagagtctcagtctgtcaccaggttcagtgacacaatcatggctcactgcagcctccacttcccggattcaggtgattctcccaccttagcctcccgagtagctgggactacaggcatgcaccaccacacccagctaattttaacatttttaatagagatgaagtctccttatgtttcccaggttgttcttgaactcctcggctcaagtgatcctcctgcctcggcctcccaaagtgctggggatcatgagccaccacacctgtccattgggcaatttttaaagagccctagaaggttatttttcctgcttgctaataaagttttttattttattttactttaagttctgagatacatgtgcagaacgtgcaggtttgttacataggtatacatgtgccgtggtggtttgctgcacctatcaacccatcatctaggttttaagccctacatgcattaggtgtttgtcctaatgctctccctccccgctaataaagttttaatatgtcttatttgataatatgataaaccctgttgagaaggagaattctttttggaatgttcaatggattgctactgggatatgtccactttttaaattgacaagcaaaaagtgtgcatatttgtggtgtacaatgtgatgttttgatatacatcacagaatggctatatcaactatttaacatttgcattacctcacatacctatcattttttgtggtaagaacatttaaggtctactctctaagcacttttcaagcatacaatacattctaattaattgtagtcatcatgttgtacaatagatctcttttattcctcctgcgtaactgaaattttgtgtcctttgtccaacatctccccaatccctctgcctctgacccccagtaaacagcatttcactctctgtttctatgagtttgactttttagattccacatctgagtgagatcatgcggtatttgtctttctgtgcctggcttatttcacttaacatcatgtcctccaagatgtgtttccttgtgaattcctcttaggagttgctgaagagtgattagtgctgcatgcatataacccccaaaaaatcaataaatatttttgagcactactatgtatacagtatataattgtcaatacaatggcgtccaatctattttatcacctgttttagacaattgctcttttaaatgcagtgtaggaaccgtgatacttaatggttctgagctgccaccttgctttgttcttgaccgtgcatttttcttactccttttccttttgtctctcctagaacactgctgctgttctgtcaggataccctgcccttcctccccagaagagttggaaaagcttcagtggtatgtaacaaacatgctgacccttctcct

SEQ ID NO: 3184 - DNA, 133147 bp, human; identical to SEQ ID NO: 3172

SEQ ID NO: 3185 - DNA, 133245 bp, human; identical to SEQ ID NO: 3173

SEQ ID NO: 3186 - DNA, 133328 bp, human; identical to SEQ ID NO: 3174

SEQ ID NO: 3187 - DNA, 133328 bp, human; identical to SEQ ID NO: 3174

SEQ ID NO: 3188 - DNA, 133149 bp, human; identical to SEQ ID NO: 3176

SEQ ID NO: 3189 - DNA, 133328 bp, human; identical to SEQ ID NO: 3174

SEQ ID NO: 3190 - DNA, 133245 bp, human; identical to SEQ ID NO: 3173

SEQ ID NO: 3191 - DNA, 133245 bp, human; identical to SEQ ID NO: 3173

SEQ ID NO: 3192 - DNA, 133328 bp, human; identical to SEQ ID NO: 3174

SEQ ID NO: 3193 - DNA, 92733 bp, human; identical to SEQ ID NO: 3170

SEQ ID NO: 3194 - DNA, 133147 bp, human; identical to SEQ ID NO: 3172

SEQ ID NO: 3195 - DNA, 133245 bp, human; identical to SEQ ID NO: 3173

SEQ ID NO: 3196 - DNA, 133328 bp, human; identical to SEQ ID NO: 3174

SEQ ID NO: 3197 - DNA, 133328 bp, human; identical to SEQ ID NO: 3174

SEQ ID NO: 3198 - DNA, 133149 bp, human; identical to SEQ ID NO: 3176

SEQ ID NO: 3199 - DNA, 133328 bp, human; identical to SEQ ID NO: 3174

SEQ ID NO: 3200 - DNA, 133245 bp, human; identical to SEQ ID NO: 3173

SEQ ID NO: 3201 - DNA, 133245 bp, human; identical to SEQ ID NO: 3173

SEQ ID NO: 3202 - DNA, 133328 bp, human; identical to SEQ ID NO: 3174

SEQ ID NO: 3203 - DNA, 101 bp, human
gctggtccgagtgcagtggtgtttgcagctagttgatgacaaccagttagagatttctttgttccttccccactcccactgtttcacttgactagttaaaa

SEQ ID NO: 3204 - DNA, 155205 bp, human
atggagagcggcggtgggaatgctccggccggggccctcggggcggcgagcgagtcccctcagtgcccgccgccgccgggggtggagggcgcggccgggccggcggagcccgacggggcggcggagggcgcggcaggcggcagcggcgagggcgagagtgggggcgggccgcggcgggctctgcgggcagtatacgtgcgcagtgagagctcccagggcggcgcggccggcggcccggaggctggggcgcggcagtgcctgctgcgggcctgcgaggccgagggcgctcacctcacctccgtgcccttcggggagctggacttcggggagacggccgtgctcgacgccttctacgacgcaggtgagagcggcttcgtccccacctcagtcccagttcacctaccctcacacgagccagggcacccgccccgccccctcgcccttctcccccgtccccctccccctcgtccccctcccctccccctcgtccccctcccctccccctcgtccccctcccctccccctagtccccctcccctcccccagtccccctcgtctctagtccccctccccttatccccctccccttatccccctcccccagtcccccctcccgcaggcccccctccccttagtcccctctccccttagtctccctccccttagtccacctccccttcccctagtccccttcctctcatccccctccccttagcccccctcctatcctctcaccccctgatccgtccaacaggaccgtcctgcctttgggggagggtagagtctttaacattgtgcccttttacagataagaaaatagaggccacgggcatttagactctttgattcttcaggcatcttaaacatcagataacccaagaaacagcctgtaacccagaccctaccaagccccccttctcccaagttatccaacttttgctttctcattcctggaaggtctcttacggccgtgggtcccaacgcaggctacatattagaatcacctggggagcttttaaaactctgggtgcccagatcggaccccagaccaatgacataagcacccgaggccttagaagtgtcatgcttcccaggcgattccattttgcagccaggagtggaaatcggtgtcttacgtgtgtgtgtgttgcctctacttagaaatacccagtgttcttttgcacacttcaattctcgtccccaaaacactgacggtggagtgtgagccaccaccctgtgacgtatattttatcccataatgcacagcattcacgggttagggggcacctttgctggagtgggactctaggtctctaaactcactataataaatgtgcctgagaatccagccttaagaagcgtactttggattggcaagagtttctctcggtgtggaatgaattgttgcttgacgttttttcccttacagcacctttggtgacaaacctctgtcacctgggtgacgttcagaagcattatatgtgagacagtaattacctgggagtccttgtgcctcagtttctggtcaaagggagttaacagtgcctaccctaaacctaaaagctgatgagataggatatgggaagttgctttgctgtaatagtaagctaggatgattaggattcagcctctgctggaggcagcgcagatctgtttttcttgcagagcaaattctccccagctggaagggcggggtagggggggagtcaggcttgtttaaacaagtggcagctggacccattgaaagcactctcctgacatttctgaccacactgagtatactcttcagcacaacatctttttagaaaagtcgttcaggagtccacttcacctagaaccactccgttttctcaacttgtattcattctgctccaaaattggagtttgaacagactcttctctgaacggttaaatgttccttttgccatgaggcacaacactctccttcctgctggtgccacctctgaaagatttgtgtgcggtggcttttgctttccctggggcggagtgtgtgtgtacggggggcccttctaacaggtcgactgtgaagatgcagacgtcaaatctcaggctttcaattctggagccacacaacagacacgtcaccttggctcactctggcctgggtggcctagaatgttgggctgtaccacgagctccctttggttaaccttgtcctggtcttgagtaaatcatttctcagtgcattagaattgctttcagaggtttgagaaagtacatacacagtaagtgggttcctgggctaaacagatgagcacctccactgtctcctggattcgtcctccatcactcactgctttttgatgtttccaccaaaaaagatacagagctctcactttggcttctttgtaaaaattctaaaaccactctgtccaatttggtagccactagccacaggtggctcttgacagttaaactgattagaatacggtaaaaatggtaagatccttagttgcactagtggcatttaaggcgcttgataggccaggtgcagtggctcacgcctgtaatcccagccctttggaaggccaaggcgggaggattgcttgagtacaggagttcaagaccaacctgagcaaaaaaaaaaaaaaaaaaaaagcaggatgtggtggcacccatgtgcctgtggtcccagctacctgggaggtggaggcaggaggatcacttaagcccgggaggtcgatgctgcggtgacctgtgtttatgccactgcactccagcctgggtgacagatcgagaccctgtctctaaataaacgaataaatgcatgctccgtaggcacaagtaactcccaggtgggacagtgaagttacagaactctttcctcatctcagaaggtcctattgaacaatgctgttctggaaaaaggcttgtgggggaggggaactgttgaacggcccaagtatttatttttaactttaagttctgggatacatgtgctgaacgtgcaggtttgttacataggtatacatgtgccatggtggtttgctgcaccaatcaacctgtcatctaggttttaagcatgcattaggtatttgtcctaatgctctccctcccctcccactccccacaggccctggggtgtgtgtgtgatgttcccctccctgtgtccatgggttctcattgttcaactcccacttatgagtgagaacatgtagtgtttggttttctgttcctgtgttagtttgctgaggatgatggtttccagcttcatccatgtccctgcaaaggacatgaactcatcctttttcatggctgcatagtattccattgtgtatatgtgcaacattttctttatccagtctatcattgatgggcatttgggttggttccaagtctttgctattgtaaatagtgctgcagtaaacatacatttgcctgtgtctttagagtagaatgatttataatcctttgggtatatacccagcaatgggattgctgggtcaaatggtatttctggttctagatccttgaggaattgccacactgtctttcacaatggttgaactaattcacactcccaccaacagtgtaaaagcattcctatttctccacatcctctccagcatctgttgtttcctgactttttaatgatcgccattctaactggcgtgagatggtatctcattgtgattttgatttgcatttctctaatgactagtattgatgggtttttttttcatatgtttgtttgccacataaatgtcttcttttgaaaagtgtctgttcatatcctttgctcactttttgatggggttgtttttttcttgtacatttgtttaagttccttgtagattctggatattagacctttgtcagattgatagattccaaaaacgttctcccattctgtaggttgcctgttcactctgatgatagtttcttctgctgtgcagaagctctttagtttaattagatttcctttgtctattttggcttttgttgccgttgcttttggtgtttaagccatgaagtccttgcccatgcctatgtcctgaatggtattgcctaggttttcttctagggtttttatggttttaggtcttacgtttaagtctttaatccatcttgagttaatttttgtataaggtgtaagaaaggggtccagtttcagttttctgcatatggctagccagttttcccagcaccatttattaaatagggaatcctttccccattgcttgtttttgtcaggtttgtcaaagatcagatggttgtagatgtgtggcgttatttctgaggcctctgttctgttccactggtctatattccttggtattttattctcttagtggcaattgtgaatgggagttcactcatgatttggctctgtgtttgtcttttattggtgcataggaatgcttgtgatttttgcacattgattttgtatcctgagactttgctgaagttgtttatcagcttaaggagtttttgggctgagaccgtggggttttctaaatatacaatcatgttgtctacaaacagacgatttgacttcctctcttcctaattgaataccctttatttccttctcctgcctgattgccctggccagaacttccaacactatgttgaataggagtggtgagagagggcatccctggcttgtgccagttttcaaagggaatgcttccagcttttgcccattcagtatgatattggctatgggtttattttaaatagctcttattattttgagatatgttccatcaatacctagtttgttgagagtttttagcatgaagcggtgttgaattttatcgaaggccttttctgcatctattgagataattgtggtttttgtcattggttctgtttatgtgatcgattatgtttgttgatttgcgtatgttgaaccagccttgcattcagggatgaagccgacttgatcatggtggataagctttttgatgtgctgctggattcggtttgccagtattttattgaggattttcacatcgatgttcatcctgaaattttctttttttgttgtgtctctgccaggttttggaatcaggataatgctggcctccttttctgttgtttggaatagtttcagaaggaatggtaccagctcctctttgtacctctggtagaattcggctgtgagtccgtctaggatttttttagttggtaggctattactgcctcaatttcagaacttgttattggtcttttcagggatttgacttcttcctggttttgtcttgggagggtgtatgtgtccagaaatttatccatttcttctagattttctagtttatttgtgtagatgtgtttatagtgttctctgatggtagtttgtatttccatgggatcagtggtgattgcccctttatcattttctattgtgtctatttgattcttctctcttttcttctttattagtctaggtagtggtctatcaattttgttgatcttttcaaaaaaccagcccctgaattcattgatttttttgaaggttttttcatgtctctatttccttcagttctgctccaatcttagttatttcttgtcttctgctagcttttgaatgtgtttgctcttgcttctctagtccttttaattgtgatgttagggtgtcgattttagatctttcctgctttctcttgtgggcatttagtgctatacatttccctctaaacactactttagctgtgtcccagagattctggtacattgtatctttgttctcattgatttcaaagaacatcattatttctgctttaatttcgttatttacccagtagtcattcaggagcagattgttcagtttccacgtagttgtgcggttttgagtgagtttcttaatcctgagttctaatttaattgcactgtggtctgagaggctgttatgatttctgttcttttgcatttgctgaggagtgtgttacttccatttatgtggtcgattttagaataagtgctatgtggcgctaagaagaatgtgtattctgttgacttggggtggagagttctgtagatatctatcaggtctgcttcggcccaagtatgttttaggggccatcatctatgggaaatttaagcacttcctgtgtcctgttctcacagcaagtcaaagtcaggtttgactgtggttttccatctccttgtagtgtttcatggggtcctgtgtgggtctaaatcttggggctgtgtcactagcacatatagtggattggatgagctgcaggaaaatggcaggcaggccttggacgtaagcaagagcaagtggatgctgttggaaaaggaaagtaccgtgggctgagaggggcagggcatgtcccatttgtgttttctaaattatttttaaatatttatttttaaatttttgtacatatatatagatttttttttgagacagggtctcactctgttgcccagtctagagtgcagtggcacgatcttggcacactgcagcctcaacctcccacacttgagcaatcctcctgcctcagcctcccaaaattctgggattacaggtgtgagtcaccacccctggcgcattttgtttattttgtgtagaggtgaactctcactctgtgagatcttatggactcgaattcctgggctcaagtgatcctcccacctcagcctcccaaattactaggattacaggcgtgaaccaccacccccggtccttgtggtttttaaaattgtgataaaatatgtataacaaaatttactattttggccatttttagtgttcatttcagtgtcattacatatattcacactgttacgtgaccatcaacaatatccatctccaggccgggcacggtggctcacgcctgtaataccagcacttcgggagactgaggtaggtggatcacctgagctcaagagtttgagaccagcctggccaacatggcgaaaccctggttctactaaaaatataaaaattagccaggcgtggtggcgtgtacctgtagtctcagctactcaggagactgaggcaggagaatcgcttgagcccaggaggcagaggttgcagtgagccaagattgcaccactgcactccaggctggccaacagagcaagactccatttcgaaaaacaaaaaccaatatcctggctgggcgtggcggctcatgcctgtgatcccagcactttgggaggccgaggcgggtggatcacctgaggtcaggaatttgagaccagcctggcccacatggtgaaaccctgtctctactaaaaatacaaaaattagccaggcatggtggcgggcacctgtaatctcagctactcgggaggctgagccaggagaattgctggaacccagaaggcagaggttgcagtgagctgagatcgtgccattgcactccagcccaggcagacaacagcgagaccccatctcaaacaaaacaaaaccctagaaaccaatatgcatctccagaactttttttaaaatagttttttagagcagttgtaggttcacagcaaacttgagaagaaaagtgcagagtgttcccatcaacccctctgccctctcccacaaactcccctatcatgagcttcttccaccagactacggcacttgtgacaattgatgaacttacacatatgttgacacatcatactcacttgaaatctttagtttacattagggttgagtttatattagttgttctttttttttttttttttttttttttttttttttttgagacaaggtgtcactctcacccaggctggagtgcagtagcgcgatcacggctcaccgcagccttgacctccctgggctcaagtgatccttccacctcagcctcccgagtcgctgggacttacaggcatgcaccacagtgcccggctaattttggtaggcttttgtcagctgcatcctgtgtctccctcctagaggttctcagtgtttgtgaacatcttaaagacttgaggcaagttgcaggaagcaaagagacctgtgtgacttcgtctcatactttctcaaatgttttgactgtggaaactatcctcctgggatgctgtaattgaatacacttattgtagtaggaagtcttaaaatgacattgggactgatagaatacaatgcttttgtcttcatggagtacaccgttttgtttactcttagaatagttaggtggttagttgtgtaagtgagagcctctacctagatgctaattagcagcattcttgagttagctattaactgcttaaatggcaagaacagcttctgaggcacaagtgatcttcccatacctgttgtgtctggctttgcataacttcactcttctctgaacctcatttaaatgttactttcctgacccaggggtcctgcttctgatttttgttttttccttctgttacgtgcacagtgatcttaaaagttgtgaagtattgcaacccatactaggatgttttcatatttcctgaacatcgataggaaaactataagactaggccgggtgcggtggctcacgtctgtaataccagggctttgggaggccaaggcaggcggatcattggaggtcaggagttagagagcagcctggccaacatagtgaaaccctgtctctactaaaaatacaaaaaattagctgggcatgatggcacacacctgtaatcccagctacttgggaggctgaggcaggagaatcgcttgaacccgtgaggtggaggttttgcagtgggccaagatcgcgctactgcactccagcctgggcggcagagcaagactccgtctcaagaaaaataaataaataaaaactaagactagggcttcagtctccagattcgttatttggttttgctctagtctgatgatactccttttctggctggcttatacaagagtcattgtggggtataaagtgtggtggagatagtgaggtggctgctaaagatttgtgctgttgccaggtgtggtggctcacgcctctaatcccagctctttgggaggccaaggtgggtggatcacttgaggtcaggagttcgagagcagcctggtcaacatagcaaaaccccgtctctactaataatacaaaaatcaggccggacgccgtggttcatgcctgtaactccagcactttgggaggccaaggtgggtggatcacctgaggtcaggagttggagaccagcttggctaacatggtgaaaccctgtctctactaaaaatataaaaaattagctgggcgttgtggcaggcacctgtaatcccagctactcgggagactgaggcaggagaatcgcttgaactcgggaggtggaagttgcagtgagccgagattgtgccattgcactacagcctgagcaacgagagtgaaactccgtctcaaaattaaaaacaaaacaaacaaaaaaccccaaaaattagccttgcgtggtggcgtgcacttgtaatcccagctacctgggaggctgaggcaggagaattgcttgaacccaggaggcagagattgcagtgagccaagatcatgccagtgcactcaagcccgggtgacaagagtgagactccatctcaaaaaaaaaaaaaaaagaaaagagatttatgctcgtagttattgctgagaaccaaggactgcatttcccagcatcctttgagtctatgtagactcatccttactaccatataggtgagagtgatgtctgccacttctgggccaagtttttggtgaatccactaggccttcccataccttctcatccctttccatggtccccatgggaaccttggagtccccatatagacgatgatggtggcacttgatggaaggtacctgactccctgagttactgtttggaggacagctggcagaggaggaatatccactttggattttgcatgtgcaagagagaagcttttatttggtctggttactgagattttggcatcgtttgttatagtaataagagagttgcaacttaggttttgaaaatctagtccaactgctagaaaattatctcctggggtaggccttaccaagaaagagtcaggctgtgggtcatctcatgtcacgaatcattactgttcatagtacatgccaatcatggagcccccctctatgctgctgtgggctaagaaaatagaaatgagatgcttggaccatcagccatcaggttaatactggcttggcgtgggggtgggtggagacattttatcttccttcatggtttcatcagttttggaggctaggtaactttttcaaatgttttatttttattattattttttacataaaatctttcaaaaaataagaggtttggtgctgtaggaaccctatacctgtttggcaagcttttgtttctgggcttttttttttttttttttgagaggaggtctcgctctgttgctcaggctagagtgcagtggcacgatcacagctcactgcagactctacctccctagctcaggtgatcctcccacctcagcctcccaggtagctgggactacaggcacatgccaccacatctggctagttttttgtacagacaaggttttgccttgttgcccaggctggtcttgaactcctgggctcaagcgatccacctaccttggcctcccaaagtgctgggattacaggcatgacccaccgtgcccagccttaggtaactttttcctttggcattaaatgatactgtagtgattgttagtttttatctgacagtgatattgggcttttttttaaacaaaagatatgaaatggtttaaaataaggctagctttagttttccttgccacctttcacgtgagttatgtctggcttctccctctgtggtggtatctctggattctttattagcttgatgcattgtgtggcaaagacagtgttcgccaaacatccatatgttcttccacatttcttcatatcccttgggccctcgtgactagtactggccagtgcgatgtgagcagcagcagcaagcatcactttgggcttaaagcagttaggtgacgcactcctccatctctctgcctctgttgtggcagacttgaagatcggggattaaagatagcaattaagccactgaagccttggggattcgtctgttgtggcagcatagcctagcttatcctgactaatagagcttgtcatgcattctgctaaaaatacctaaatacatctcttttctctttctttccccctcccctcccctcacctcccctcccacagggtcttgctctgtcacctagctggagtgcagtgacacaaacagggctcactgtaacctcaccttcctggactcaagcaatcttcctacctcagcctcctgtttgtgtagctgggactacaggtgcacgccactatgtccagctatttttacttttttttgtagagatggggatctcactatattgcccaggctggtctcgaactcctgggctcaagtgatcctcctgcctcagccttccaaagtgccgggattacaggtgtgacccaccatgcctggcctaaatgtacgtcttgtttcaacttattttagtgggctcagcccacatgtgcatttgctcctgcaagaaggagcctgaaaaatgccttaagacttcttatatcctatggccgggtgtgatggctcacacctgtaatcccagcactttgggaggccgaggcaggcagatcacctgaggccaggagtttgagaccatcctggccaacacggtgaaaccctgtctttcccaaaaaatacaaaaattagccaggcatggtggcccatgcctatagtcccagcttcttgggaggctgaggtaggagaatcacttgaacccaggaggtggaggttgcagtgagctgagattgcgccactgcattccagcctgagcaacagagtgagactctgtctcaaagaacaagaagataacttgctgaatattccttcctcatcattctggagaatgcttaaagttcagaggaagatggacctgtgggagatgttggtttgatggctgtgcagtgatgaaacaggcagccctctgatacagcacatacgttttgcatgccatctacacatggtcaggagactggccacatttatttctagcagagcataggagcgatagttaatttagacattgccatctataagggtaagtaaacatggatgagtaaaatcccccacctagcagttcatgtcagaaagctaggagtcagtgatcccactctctccctcattgtcaaatccaggtagttacttccaaaatgtttctcagatttgcccgcttctctctatatgccctgctactgtcttggtctaagcaccatcttgtctcatccaggttactgtcagtagctttgtaactggtctctcaaagttgggccggtcttgctgcgttcaaatttatgtatctgcctagaggctactgtatcctggtttccgtccccatattagtctattttcacagtgctacaagatagtaactgagactgggtaatttatatacaaaagtggtaattttgttttgttttgagacagggtctcaccctgttgtccaggctggagtgcagtggcacaaccttggctcgccgcaacctccactttcccgggctcaagtgattctccagtcacagcctccagagtagctggcattacaggcatgagccaccaatgtctggctaatttttgtatttttttgtagagatgggcttttgccatgttggccaggttggtcttgaactcctgagctcaagtgatccacctgccatggccccccaaagtgttgggattacaggtgtgagccactgtgcctggccccaaaagaggtttaattgaatcacagtttagcatggctggggagggcttaggaaacttaaaattatggcagaaggggaaggggaggcaaggcacgtcttacatggtggcaggagagagagagagcacaggggaaactgccacttttaaaccatcagatctcatgagaacttcctcactgtcatgagaacagcatgggggaaccgcccccataatccagtcacctcccaccaagtccctccctccacacgtagggattataactcgagatgaggtgtgggggacacagccaaaccatatcagtccccacccccacctgtagtcttcctctgatcaatacctgttcagctttcatatccaagttcttcaagggagcctgcatggactcccctccttctccctgttggcttttgtatgctgaggttttctttcctcacaggcaaaacaattgtgattaaataataattattactttttgagactgagtctctgtcgcccaggctagagtgcagtggcacggtcttggctcactgaaacctccacctcccaggttcaaacgattcacctgcctcagcctcccaagtagttgggattacaggcatatgccaccttgcccggctaatttttgtatttttagtagagatggggtttcaccatgttggccaggctggtctagaactcctgacctcaggtgatctgcttgcctcagcctcccaaagtgctaggattgcaggcataaggcaccgcacccagcccttaaataattattgatttaatgattgatcttctgccagacagcgaactcttcaatggccgggagccaggtatagttttctttgccactgtttgagtgattgctacgaatatctacccagctcctgttaaaaataatcatcagtgggcacagatgacagctggcttctcctgttgagataaagcagatcttatgtggtgccctcaaaagaaatttagaatgcagtttccagtggcatgttgaaaatggtagtcaggccatagatagagtgcacttacgattttattaagaagtaacatccatcctaatgacagatttctaggtctgaacctttctcttcagtggtgcatatctgacagaagagactagaagaactcaaactggacatgctgggatggaagtagtggtttcagttattgctgggaatggaataccggttctttttcttctggtttgtccatattttctatactgtatgttattttctagaatataagtacgatttttactttaagtacagtaggcgattaaagatggcgttgtaactcagaagccttctccctttctccctccctgctggagagagtggccaggcgtgctcaggctagacaaccatgagtgctcccagggacccccggctgcagaagtccatggctggacctcagctgtcttctgttggatttggctgttggcttgtccataggggcccttccctgagcttccttcgtttccatgctgctgttagtgctactgactcagaattgagcctggaactttcctcacgttagttatgtgggccaactttgaaagaagcatttcacctgcagcatttaatggagacattgctgtttgagccttgagtgcattttagagtagatatccgtgggctggtctgctaccttactggctgtgttattatctgttactaggacaaaatgtattttcagttccctgcagtgaacttccaaacgtagttttggaatacgagccataaactgttttaaaagtcttctatgtatctggctttgaaataggtgctgtttcaatcccggccaaataacatggttggaataggactgaactttctgtaaagcaggctggcaaaattcttgtttcccagtaacttgcacaggttttggcaattgcatgtgatgggactggcagaaatgcctggcggttgttggggcttggtttggggagggagagtggttggggagcagaagggagttgagtagtgggtgagtcctggcaggaagtagagctcattcaggaattggggtttgtggcaggccatcccaggggccaggcagaactggacacagatagggaggggaaagagaaggtagagagagacaggagcattcgatgtagataactttccctcttaaattattttatcatggaaaatttcaagcatgtacattacccagctctgacaattattaacatcctgctgttctcatttcttctttacctctatccattccctacctcatacttgattattctttttatttcattatttttatatttatttagagatggagtctcactctgtcacccaggctggagtgcagtggcgcgatctcggctcactgaaacctccatctcccaagttcaagcgattctcttccctcagcttcctgagtagctgggattacaggcatacgccaccacacccagctaatttttgtatttttagtagagattgggtttcgccatgttggccaggatggtctcgaactcctgacctcaggtgatccacccgccttggcctcccaaagtgcttggatttcaggcgtgggccactgcacccggccaattattctttttaaacatattaaatgtaaaatgtataggcattgtgatatacaaatctcagctgtacaactttaaaaaatgactaaacctgtctaatgcaacccccatcgcaatatagagaacatttctgtttttccagaaagttccatcatgtcccctctccctcaatcctacctttacccctataaggctatgactgatctgctgtcatctctgtagattagatctgcctttcctagagcttcatctaaatggtctcatacaatatgtattctttggtgtctggctttgttcactcagcatgatgattttgagattcgtccatacagttatatgtatttgtagtttgttcctttctaatattatacaattttattgtaagaatataccggttagtttaggcattctcctattgatgaacgtttgggttgcttctagtttggagttgttaacaaccaaagcagctctgaacatttgcaatttgcaagtctttgtgactttttgtcgaccagtgtttttattcctcttgagtaaatacctatgagtagaatggctggatcaaagggttaagtgtgtgttgaagtatatcagaaacttccaaccctttttctgaagtggttgtaccattttatattcttagcaccaatgtgtgacagtttcagtggcttcacatcgtcaccaacactgtattaccaatcgtgtcaattgtggttcttctcataagggttgtggtggtttctcctcatggttttaatttgcctttccctcatgattaatgatgttgagtacttctccatgtgctttttggacatgcagatatcttcctttgtgaggtgtccattctagccattgacccatttaattgggttgtctgtcatcttattattgaattatgagaggtttttatgttttggatttaagtgctttgtcatatattttgtgaatatttgctcccagactgtggctagcttctccatgtacataatggtggcttttgatgagcagaagctcttcgttttgaagaagtctaatctagaatattattcttttatggttgcctgctctatcttgcctaaggaaccttccaggttgcagttgtgcaggaactcttttatgtgttcttccaaaaactttgtttcggcttttacatttagatctgtgattcatctcaaatgaagtttgacacagttcctcttgacaaaccgagcctgatgccttgaacacgtgggatgccagtcttgccccacgatgagtgcccccaggcactttgagtccagaaggcaggaccactactgcctccttttcgtctcattatccaggaaagtacaggaagtgcaggttatccttgatgcagtggcctttctgccttccggagcaaaaactcccaccagagacctataatgaaaccttctaaacatgtcttctatcattgtgtcacactggccctggtgatacaggtggtgacggagaaagaccatttgctttataggtctgagtttggatttctatcttctcgtttattggctgtgtgagcctggataacttacttaatatctctgagcctcatttaaaaagacccctgtgtagagattcaaagtctgtgccttgaacttagtaagtgttcagtaaatgtcagcaccctcccccacctgcaccactccccttgacccccatcaataaacataccagaaccccagtgtagaatgaaatgtgctttgtgaaataataaattgctgaaacccggtgtgtgaactttttcacaaagtattaagttaatgtttccataatttaaactagtttattggaataactacattaggaaatatatgatacatgccaaagcttgcttttatgtttaaattaatggtatcgatcagtatacatttccatttatcacatttcacttgttagtatatattctttttatacattatttaaaagcagcaaagttatttagttaaataaaaaatgcagggctcagatcccttgggcagttatcatgtagtggggttgctttatatgcctgcaggttgtaaggaaagttttcaaaattctgaggttgaagattgcatcctaaccccattccttgtcctgtgcagaggaacgcaaacttgtgccacttgattttgaggtgttttgtcatgtagtagtagtaatcagaatataataaaatatctctgcatcttatcgacaatgcttactaatgcaccaggatatcctaatgccagccatgttgcatcagcccagttctagccatacaagataccttgtatggccattaatattgagagtaaaagaaatgtagaataaatgggacaaaaaggaaatgaaaattgttgatattgtaaaagtgcttcattggtctccagtaaatcccaccaaatattttggttgagctggaagcaaagaccattttgatgttcacaatgattgtcattggctctcacaaggctaaagttttaagacttgttagatgagtttattttaaaaatgtgttatctgggccaggtgtggtggctcatgcctgtaatcccagccctttgggaggctgaggcaggcggatcacttgaggtcatgagtttgagaccagcctaaccgccatgatgaaaccccatctctactaaaaatacaaaaattagccaggcgtggtggcgcatgcctgtgataccagctgctcgggaggctgaggcaggagaatcgcttgaacgtgggaggcagaggttgcagtgagccgagatcatgccactgcactccagcctgggcaacagagtgagattccatctcaaaaaaaaaaaaaaaagtattatctatcctgagaatgagaatactgcatccaatgtgcttatcattgctaagaagcaaatagataagtttttgtaaagcactgtctggctatggagtgcttgatgcagatcataaactctgcacatcccttctcaaaggaccacctacgaaaaaggaaattggtacatgaaaaaaaggaaattagaaggggcaagttccaagcaacatggcccctgtatctagcaatgagtcaccactcccacaggctatggggacagatactgctgaggaagcgtaggggacagatactgctgaggaaacgtagagcacagaatgggtgaaatcagcagccaggcagaagtccggatgcttagtgatgatctttaaggagctgttgattttgttaaggaaagagtgtattattgtgggaggagtatatgtaaaagcgatggttccctcgagccggctgacattcattttaacaagacctaattaagaaatgcaggggctacttactgtgatttttgtcacagtaacaggaaagctcagcggtgcccttgtcagggtctgcagcgtgtggctggagtacatcaaactctgcaccactctagaattgcgcacagtttgaaggtgatgtgtgacacagaccttttgaaagaagaggttgctatctgctggtcagaaaaggcttctcagaatgtgtctccaaaaattttgctacagagagtcatgttaaagcgttccctttagaaaagggttgaggaaagctgaagaggaatcttcagatgacgaagatgaaaataatgggatggtggccaggcgtggtggctcaagcctgtaatcccagcactttggggggccgaggcaggtggatcacttgaggtcaggagttcaagaccagtctggccaacatggcgaaaccctgtctctactaaaaatacaaaaattagcctggcgtggtggtgcacacctgtagtcccagctactcaggaagctaaggcacaagaatcgcttgaacctgggagatggaggttgcagtgagctgagatcatgccactgcactccagcctgggcaacagagcaagactccatctcaaaaaaaaaaaaaaaaaattggggtgatgtgttcactggctgccagggaacccagagttggagctgtgaagggtgtgacagcaaggatgatgacaatgatatcaatacccatgtatttttatttttttagagatggggtctcactctgtcacctaagctggagtgcagtggcacaatcatagctcactgcagtttcaaagtcctgggctcaagcgatcctcttgcctcagcctcctaagtaacaatattgatagcatttaaagtgatgaatgcagtctagcttgcagtatcatgctgcatatttttctgtattgtcagatggaagaacaatatgtatttgcaaaagatgaagtggcttaactcatgctataatgtatattgcaaatatttcactttgagtggtctcaaattaagcccattgagcccattcacctcagtgagtaaaacgtagttggcatatatgtgctgcatttcttttggaaaaactggtagtagacacatctcaatcacacttacatagttgaaaaaaaaacaaaagatttactttcagtcattcttacaaaaaaatttgatactgggaagcaaaagataggccaggtagtttcctgatgtcctcacgcctcccctccttcctcctagttaaaactcgatcccccaggcaacgagtaccactcactatgacacttggtaaggacttgctgatgtcctaacactgaattggtatattggctccttcttatgagattggaaaataagatttaagtgacacttcaagctgggtgcggtggctcatgcctgtaatcccagcactttgggaggccgaggtgggcagatcacttgaggtcaggagctgaagaccagcctggccaacatggggaaaccccgtgtctactaaaaatacaaaaattagccaggcatggtggtgcatgcctataatcccagctactcaggaggctgaggcaggagaatcacttgaacccaggaggtggaggttgcagtgagccaagattgcaccactgcactccagcctgggcgacagagcaagactccatctcaaaacaaacaaacaaaacacttcacaactttcttcactgacttgacctgagtatgttggaaataagcagcagtggataagtaagatctaaattatggtaggagttaggagaggtgccttctgtccagtatatctgggctttttttttttttaaaggtagcttttaggtagctagtgttgtcatatgtccaatccaatttttgttttgaagtctttggccaaaaacttattctgaagtctagcgcttttcattttgacaaagccagtcttacttactttcataatttcttttttttctgcagggagttagatagacttaaggataacctggtatatatttaaagactggtatgagccagtacagtcacagaattactatatggtaaatcatttgccatcatatcactttgttgactaatgctttgcttcagaaatcagatacttttaaaccacactagaaaattatagttttatgtattacccataaaacatttagcaaaaatagtattcaagatagtgttcaaaagttttcaacgaactaaagtcctatgcatcatctttcttatttaacactagcgtgtttcaaggtccttgtaattgacctcctgcttgaggtcattgtaactggtttttaaattacactttcctgctaagcatagatttcaactggaaccttggctttttgcaaatccttgatgtagtatctctctccctcctcctctctctctctcttaaaaagacagagtctcattatgttgcccagactggacttgaacttctaggttcaagtgctcctcttgcctcagcctccagagtagctgggacttcaggcacacgccaccatgcctggtatcacttcttaaagtttgctaaaccaagataggtagggtgggtgtgtgtgcctgcctcagggtcagaaaagatggtttatatgatatgtgttttttttttccctgaagctggcctgcgtcagtaggaactgaaaggtaatggttgctaggagcacagggtgtatttgggaatgaaaatctgaattttatctcttcctttttatctgtgatctttttgcttaagatttagcctgatatataaatttgttttgcccccaggtagctcagttttacacagtgtgtcaggaatgtactaagcctcatgagggcatcggggaacacaggacttggggttggaaaagctgattttgagccctgacttgttcatgctgtacttgagcgaccttgggcgagtctgttaacctctttgcacttcatttttctacctgcttagtgaagccagtgcttgccctgcctgcctgctggggttctgaaattcaactgagaagtctgtggaagtgttttgtaaatggcaaagcatgtgaccacggtgatgatgaaaggttttaggtaactggtgctctctttagggataaagcccttttttctttgtatagaataaaagttccaatctggtgttttattacaattaacaatttataaatcagatgctaaattcgtgttttaggaattctgaaaataagccagttgcatactattttggtataaatcctcaaagtgaacttagtctactggcctgagtgacaaatgtcaggcaaaaattccaactttagattcgaggcagttttcctattgaacatgaattgctcagaattttttttttttttttttttgagtagcagtattaatatgtcctgttttcattgacagtgaaaagtctctcccaatccttggtaggccggtgggtcccagcacagaatgttgagaaggcaaagaagggaggacttcatgtcacttgatcaaaatggaatcttggcaacaagttcctctgccacgttcaaggttgcctgtgaaaatgggctgtgtgacttcgggactactgtccctatcctcccttctgccccgttccgctattcccctttgtctgtttctatttgcttccttgcctttattaactaattataacagtcaccatggccttggaattaatatctatgttgctactttttcataacatcactatgaaacatgtaattttaaaaaaaatcttttgagacagagtttcgctcttgtcatccaggctggggtacagtggtgcaaccttggctcactgcaaccgcctcctcccaggttcaagtgattctcctgcctcagcctcccgagtagctgggattacaggcgcccaccccacacccagctaattttttgtatttttagtagagacgggatttcaccacgttgggtaggctggtctcaaactactgacctgaggtgatccacccacctccgcctcccaaagtgctgggattacaggcgtgagccaccgcgcccggcctgaaacatataatttttaatgtagataagtaagagtccaggaagcaatcctataggcagaatgtctaatttactcagctgcagtggcgcattatcttgactctaagcaaatgtctttggggagtggaattacccatttgagagaaattgatgaggctgggttgtagagtgtttcctcagtatagacgtgcatcctttcattagtagatgacctctaaagggtaaatttgactctgagagtctcctgctaaaaaactctcttgattatttaaaaatatttttaggtgagacattgatactatggttatttttttctttgagttctcatcttttagtgatatatcctgaaatattgggggataaaacaacgtggtgtctggtgggatttattttaaaataacacagggagggaggggtggatgttgcggatggtagtaaagatgaaacaaagccggccttgagttgatcgttgttgaggtgggaggtatggagatttcattatactattctgtctactttttatgtatatttgtagttctgcataataaaaagttttaaagaggccaggagcagtggctcacagctgtaatcctagcactctaagaggccgaggtgggaggattgcctgagcccaggagttcaagaccaccctgggcaacagagtgagaccccatctctgtttaaaaaaaaaaaaaaaagtagccaggtgcagtggctaacgcctgtaatcccagcactttgggaggctgaggtgggcggatcgcttgaggtcaggagtttgagaccagcctggccaacgtggtgaaaccccatctctgctaaaaatacgacaaaattagccgggcatggtggcacatgcctgtagtcccagctactctggaggccaaggcacaagaatagcttgagcctgggaggtggaggttgcagtgagccgagatcgtacccatgcatttttgagactctgtctcaaaaataaataagtaagtaaaaataaaaagttaaaaaacccaaccataggtttcccattgcctcaaggaaggtccagccctccacctccaggctcgttttctggggtattgtggccccaggaagtgatatgtgggtggccttcacacttacaccctggcttgctgctggccccttgcactagctggcttctgttaatgcaccgctctttccttccctttgatcccccatatcctcatcccatttgcctgcctgactcttacagagcctcaggtcatggacagtatcccttcctccaggcattctgtgattgccctccgctcaggtgtggattatgtgccctcctgggggtgctctgttcactgtttcccttattttggctgccctcatggtgatcctaaccatccccttccttctggttacccacattgtattgtagttggttttttcttttgaggaaagtgattatgccctgttgacacttctatccctggcacccatcagaatcctgccatacagcaggcaatccataaataagagaataaagggcccactctggggcttagtggcacttggcctcaggttcccagcgcctctctacagagctagcggtgtctggtgctgatatgctgcctgcctgccttcatgtttcttcacgcccttgttcaactggcctctgttgtgtcccatcgggattttgagtgactttctagaagtcacagcagtgcgagcatgagtttggacactacattcctatatctccactgcacatggtaaggaagctcccatcaaacttggaactcttacatcctctagaatgttttgagttttaaaacggtgccccatactactaagcgtaatttaaacatgctcattattcatgtaataagttgctcctctgttttgaataggtctctattacagggtgcaactccagggtgcattttattttttttttttttttagtttatgagacaaggtcttactctgtcacttaggctggagagcagtggcatgatcacagctcactgcaacctcgacctcccagtctccagccatccacccaccttagcctcctgaataactgggactacaggcacgcaccaccacacccggctaattttttgtattttttatagagatggggtttcgccatgttgtccaggctggtcttgaactgctgagctcaagcattctgcccacctcggccaactaaagtgttgggattacaggcatgagccactgcgcccagccagggcacgttatatgttgttaagttgatggtagacatgtgagccaggagctatgacaggactgtttattgcagcagtgtgaaataggaaatgaataaaaatctgtcacaacagaattctatacagaagcgaaaacgtatgaactggagctaaacgcacaaattggttgaatgccaccaaaaaatagcaagctgaagaatacatacaatgcaataccatttatatgaagttcaaagacatgcaaaactgagcaatatactgttaaggaatttttgtatgtatgtgtgtgtgtgtgtgtgtgtgtgtgtgtgtgtgtgtgtgtgtgtataatgcctatacatgcctgtacgtattgtcttagtctgtttggactgctgtaacataatgcctgggcatggcttctaaacaacagaaatttatttatttatttagagacagagtctcactctgttgcccaggctggagtgcagtggcacgatctgagttcactgcaacctctgcctcccaggtacaagcgattctcctgccttagcctcccgagtagctgggattacaggcacctgccaccacgcccaactaatttttgtatttttagtagagacggggtttcactatgttggacaggctggtctcgaactcctgacctcaggtggtccacctgccttggcctcccaaggtgctaggactacaggcatgagccactgcacccagccagaaatttatttctcataattatggagactaggaagtccaacatcaaggtggcggcagactcattgtctggtgaggacctgctttctagttcacagacaggaccttctccctgtgtcctggaatgatgaaagggggaaagcagctccccggagtctcttttataagtgcactaatccaatttatgaggcctccatcctcatgacctaatcacctcccaaaggcctcatcttcaggtaccatcatattgggggataggtttcaacacatgaaccttgaggggacacaaacgttcattctatagcgcacacacacgtgcgtggaactgacaaatacatagatccggacagaaatgctctctgggcaggagggaggagatgtgatcagggaggggcacatgggaccctgagtgcaggtaaccctctgacttgggctgcacagaaggtacatggtttttcgttgcattatactttatgcctcatatataagctaaatatattcttcagatgtgtgatatgtcataacaaaaataacattaaaaatccatcagcaagttctaagtgaggttacattcccagcactttgaagaagaaagaggattaaaaaaaattcttactgcatttcttccacagttcatagggtaattttaatcaaatcattccttactttacctaacaggctgatgacagaaatacacattgctatagctcctcactggtgatcaccagtgagtagatgaagtagacagatcatctcccctaatcctgtcctctccttgttcattgcagatgttgctgtggtagacatgagcgatgtctccagacagccttccctcttctaccatcttggagtccgagaaagctttgacatggccaataatgtgatcttgtaccatgacaccgatgccgacactgctctctctttgaaggtacagtgtattcaccttctcctgagtactttgttttgggaaagcagaattatatgtctagctgaaatgccacagtagcacaggaagttggagaaaaacaaagacttgcttgtgcaattctttccttcccaccacagattctagttcacacagatgacttcctggctacttcgtgagcatctgtgctacagtcgtacgtttgcaggcaacttgggcatttccgggctcgttagggaagtggaggcaaacactcctattagtttccattgaagcaaacacactgtcccgaattccttcatgagcaattggatccaaacctacacataaaaatcagttctgaattccttcatgagcaattggatccaaacctacacataaaaatcagttctcaacttggataataatatgaagacattgaacagttaccgaaatggacagaatattttagtatagacacaattagtctttgatgttattttcccccagtctgaaagcaaagcaaaactgaaaacgtgtgtgttcctgcacaactcaatcatggttgagaatttctaaaatgtatttttgcaagtttgagacaagcttttttgggtaacatagtatttttttaaaaaatgcttgcatttgtatagtggaaatgtttaacatgagttattccaaaattcagtggatattgatattgttgaatattttagtcagaaaatcctggcctatgttaaatcattttaggaataatgaattagtttgtttatagcagtgcttctcggccttgagtgcacttcagaattactgggagagcttgtaaatatccccatgcctaggccccaccccagaccaattacatcacagtctcggggatgggggttgggaccaaggcacggagatttttttaacctcccaaatgtgcaaccatgggtgagaaccaatggtttggagagtcagccttcacagacatcatttctaaaggttcagttccctcagtattaaaaatcactggtagatagtagtacaattttatgccaaagttggacattttcattgtgtttcttgagatttaatattaactagattttctgggttgtgtaaggatttgagattatttcctggtagaaataccacctgcttgagatgtgtaacttgtatgtgctaaacatcatatatactttacatagatatgtactcagtaattatggcaaaatactgtattttaataagtcatttgtatgacagtgaaagaagaaacttttattagtgtactttacattgtagaatagtttccccagggctataaaccaatgtgaattacattagatagttagatattgaccttttcttttactgattttcaccaaggtagctatgcttaggaatatttagaacttagcaagtatgaaagatatagattattaacctatattttgatgaaaaacatgaaattagaatttttttttcaatttaggacagtttcttcaactgtgccttagcaaagccctctggaaagttcaatggactagatgttttaatttttaataatacagaaaaatatttcctaaaatggaaatgggtagtcagttatatttaacaccagaagaagcagtttgcacttgttatcaggaaataaaaatctgagaatatataaaacatgttttacagggcagctgtttagttatggtgttttctccgcccttccccccccccacccccagaaatgttggtgcgtaaatgagacagtcaaaggctgcctaattatcatactaaatttactgactagaattgttgtcattgaatttgaacattcctagacagttgtagcagggtgtcaggaattctactaccaacaccccttctgtaggaaggctgactgtggtgtggccttcacattgattgattcaggaagtggttccagatccggggatagcacggtgccttctgggccctttcttgctatcgccgacattcttttctgggaaggcaagatgcagggcactcagcaccccaaacttgaagctcaaaatatcttttgggcaaaagcattggccctgttctggggaaatccttataaatgccccctaatagttccagagactaaccagtggtgatcaattttctttggaatatcaatgttgcaattcagaggttcattgtgtttgaagcttttggagagggaggtttcacatgattaattcttgctctaaggtgggtgcttttatgtgattaattcttacatgattaatttcttttatagaggggagtgctggctaatgcttatggaaattagctgttttacaaaaagctatattcatcttttctttttcttttcaggacatggtaactcaaaaaaacacagtaagtattaacattttcagaattttaattctgaaattaaatgtaaatgtcaatttgtaaaatgcttgcctgaaaatcgcccaggtagcaagatgacttctaatcacgcctgtgggttgtgtttctaaggaggacagctagaaatctccctatgcctcaaccggccggccccaggccccactcagccattgaggcagtgggccagaaggcaaggcaaggccaggcaagaaagtgtatgttcttcattacctgctgggactttgagctgtaaccttctgggtgactccttctgatctgggtcgatgttccatggaccaccagtaatcgttttgctggagtcaatacctcccatacttcccaagcagagtttccctaatgatggaggaacgtgaagttgtatgccagttaatatggggcaaaagtttcttgccacaaacggaaaagaagtgggatggaattctacttccttctgtcccatttatgtactgaagtctcctgatttggcttaaaagttcctgaaattacatagttttattgccacgttggtttgaatagtataatgaaatcaccaccctaaaaatgttttaaaaggatcttggccttggaaatgttgccaaggttatcctgtacccttgagtgcactccaagctgcccatccctccagacctatggcattgtggtttgagaaaccgtgacctagactcaggacaggcccttggtcccccaccttacagccttagtctccttcctgctagctcttctagaaggaacaggcctacagactctcttcctattccagttggagttcctaggagagggagaaaagggcccaggaggcaaagctttcccctgggcgccctctgcagaagtccccaacctgcagcttgggggcccaggcttccccaggaccctgacagagctccccacctgagacataagtttcagaaacagagcacgtggtatagtgcacgtgattactattggagcatgaattttacaagcaggcctgtaagataaggcatccggtggttttagattccttttggaaaagaaatgggatcaggtgtgactttttttggtcccatttacatgctgatgttgtccacttgtaagagtctttcctgttcttcctagagcttgactttttttttttttttttttttttttttttttgagacagagtctcgctctgtcagccaggctgaagtgcagtggtgtgatcttggctcactgcaacctctgcctccagggttcaagcgattctcctgtctcagcctcctgagtagctgggattataggcgcctaccaccacgcctggctaatttttgtacttttagtagagacatggtttcccaatgttggccaggctggtcttgaactcctgacctcaagtgatctgcctgccttggcctcctaaagtgctgagattacaggcgtgagccacctcacccagccttgatttttaaaattacctaatttgtggagaaatggggaagaagtcgaaggagattgggcctgaggcccaggaggtgcagttgtagccgcagccctgtctctaagtaacactgggcagtcagttgttccacccctgcctaggcctcaggatcctcagcaataaaatgagaaatgttgaactgtgctgttttgctcattgataccttctagccctcaacatctgtagttccatatttgttatacaagcaaaaagatgtaacctggatttaatgcaagaaatggctatgaaatgctgattccttaaaacagcaagagttacgttgaggcaaggagcaaggaagacaactcgttttctttctccattcctcactgttggatgcatcagtactcagaaatagtctctcgtcccggagacttggtgtcacgctgttacaattccactacatacctccctcctggtgcattctccctcttccaaaacatccaggaattccttaacattcttagtaattccaagtataccttggcactattcttcctaggtatctgtttgctttttaggaataaacttactctaaagcagcggtccccaaccttttcatcaccagggactggtttcatggaagacaatttttccacagaccagaggtgggggatggtttcaggatgaaactgcttgacctcagattatcaggcattagattctcgtaaggagcacgcagcctagatcgctcacatgtgcagttcacaatagggtttgcactcctgtaagaatctaatgtcaccaatgatctgacaggaggtggagttcagacaataatgcttgctcacccaccactcacctcctgctatgtggcctggttcctaacaggccactgaccggtactggtccatggccccgggggttggggacccctgctctaaaggatttggcagctaatctctttgctatatttggcattatgttagaatttggtgcccagtattggttgtcatgcttggcaagatgtgaaaatttagagcactcagaagactaaaaggatcccaggtgatgggatgagtggaaaattgcactaagaggaaaagctaaagggaactaagccttgaggggtaccattagtagtcatcttcaaatgctatcctctttctgaaagaaaagagacgtttactttttccactccagatgggatggaagtagggtaaacagaaaaatggtttggatcagcagaatggacatcttgcaactaatggtggttaaacattaaaatagaatgtcaaagtaacttgggtggcttctaaggagaatttgctcaattgtcccctccatgtggattggggtgaccctggaatcagacacctggatcatacgaccccagagattccaagacagaatctgatggaattgtgggtttatgatcattttggaaagattttgattaacacacacacacacacacacactcatagttagtgaacagtgaagtcttataaataaggggtacgaattagatgccacaccctgaacatgtagccaggtgtttgaaatgatttctgaatatgtgaaaaccaagatgcattgagatctcttttcaaggagtcatttgatatttctaaaattgtacttttacccagaaagggagatggaaaaataaaaagtaataaaataataataacaaagataaaattgtgcttgatgatgtattgaattcagctttatgtggcagcgaagtgggcacatttatctccatttcttttttttttttttttttgagatggagtcttgccctgtagcccaggctggagtgcagtggcatgatcttggctcactgcaacctctgcctcccaggtttgagtgattcttctgcctcagcctcccgagtacctgggaatacaggcatgtgccaccatgaccggctaatttttgtattttttttttttttagtagagacagggtttcaccatgttggccaggctggtctcaaactcctggcctcagatgatccgcccgcgttggcctcccaaagagctgggattacagatcacgttgcctggccatttgtctccatttctaggagcagttgctttgcagggatgccgaggccaggaagccaaactccagacttcagggtggaccacctgcagctcttctgggtttctttgctctttggaaacatggtatcaccttttgtgttcacctctttttcagatgatgctcatattcttgtgttctggttttgttttgtttttttgaaatgctttatgtaggtataatttacataccacaaaatgtacctagtttaagcacacacaattcaatgatttttaataaatgacataattgtgcagccagttgtgggttgtgtaccacagtctagttttagagcatttccctgaccccaaaatgcttatttgcagacaatctctcttcccacacccagccccaggcaagaactaatctgctttttgtcttatagacttgccttttcaagacttctcatgtgaaaggaaccatacaatatgtgatcttttgcatctggcttctatcacttaggatgatgttttcgaagatcatccttaatgcactaggatcatggatgcatggatcagtagttctttcctttttattactgaatggtattctactgtatagatattccacattttatccattccctagtagatggatttttggatcgtttctactttctggctattatgaataataccactgtgaatattcgagtgcaaatctttgtgtgggcacattttttttttcctcttggatacatacctaggaatggaattgccaagtcatatggtaaatataggctttttttttttttttttgagctggaatctcactctgtcgcccaggctggagtgcaatggcgcgatttcggctcacggcaacttctgtctcccgggttcaagtgattctcctgcctcagcctcctgagtagctgggattataggcgcccaccaccacgcctggctaattttttttgtatttttagtagagatgcgatttcatcatattggacaggctgatctcgaactcctgacctcaagtgatccacctgcctcagcctcccaaagtgctgggattacaggtgtgagccaccgtgcctggctggtaaatatacctttaatttcttaagaaactgtcaaaacaattccaaagtggctgtaccattttacatttccaccagcagtgagaggtccagtatcttcacatccttgccaatacttgatatcatctgtctttttattatagccattctagtgagtatgaactgatacctgagtgtacttttagtttgcatttccctagtggctaataatgttgagcatcttttcatgtgctgattggtcattcatagtcttctttggtgaaatgtctgttcaaatcttttgcccgtttaaaattgggctgtgttcttattacgaagctgtgtaagagttctctatacattttggaagcaaggcccttattagaggttttatcaattatttcttttatggatcgtgcttttggtatatctgtgaactcttagcccaaaccaaggtcatgaagtatgactcctatgttttcttttagaagttttatagttttagctcttacatttaggtctctgatccattttgagttaatttttttgtctggtgtgaggtagatgtccaacttcattctttctcatttggatccctagttgtcccagcactgtttcttaaaaaaaagaaaaaaaaaaactgtcttgtcatctttgaatcatctttccaccctcgtcaaaatcaattgactgtatacgtaagggtttatttttggactctcaattatactccattgacatatgtgtctactcttatgctaataccacactggtttaaaacttttttttttttttttttttgagacaagttctcgctctgtcacccaggctggagtgcagtggtgcgatcatggctcactacagccttgacttcccctggttcaggtactccttccacctcaacctcccgagtgcctggaattataggtgtgcaccaccacgcccagctaatttttttattttttgtagagatggggttttgccatgttgcccaggctggtctcaaactcctgggctcgagcagtctgcccacctcagcctcccaaagtgctgggattacaggcatgagccaccatacccagcccttttttttttttttgagacagagtttcactccagcccaggctggagtgcacaggctccgctcactgcaacctctgcctcccgggttcaagcaattctcctgcctcagcctcctgagtagctgggatcacaggtgcccgctaccacgcacggctaatttttttttttttttttttttttaagtagagaccgggttttgcagtgttggccaggctgatctcgaactcctgacctcaggtgatccacctgccttggcctccaaaagtgctggaattacaggcacaagccaccgtgcctggcccgcacccggccctttttaaaaaatttatttttctttgttttttgttttgttttgagacagggtcttactctgtcaccgcagctgtggtgcagtagtgcaatcacagctcactgcagtctgcactattttgattactatagctttgtagtaatttttgaaatttggaagtgcgaatcctctaactttgttctttttcaacattgttttggccatttggggcctctcaaagttccatatgaatttgaggatcagcttttccatttctggagaaaaaaaaagccattgaatattgataaggattgcatcgtatctgtagattgcttggctggtattgacatcttaatagttttaagtctactaatctgtgaatgtgggatgtctttccatttatttaggtcttctttaatttatttcagcaatattttgtagttttccatgtacaggtctttcactttcttggttacacttactcctgtgtattttattcttttggatactcttgcgaatggaattgttttcttaatttctttttcaaggttgactttaaaaaaacacctgtcacaaaaatcttcaacactacatttcacttcatatttcagtatttgattgagttgaaaatgtaattgactttttggtcagagttctatacaaatggcttctggtttttcctgtattttcatccattttaattcttacactattttatactgctttggagatgacagagatagccactttctgcagtttatcactttagagaaaacatgtttatatggtgacagatcaaggctgtctttatgaaagtaaaagagtgaaaatacagccaaccccaaggctactttatctgtttaaccttggaacttcctagtactttgccactagtgtacatagtccataggcattgcgtagcttcatttgttttaattttccttagcaaggataatcatacctttatacttacagcttattttgcaggttgatttcctctagactcagactctgaggctgagtttagggtacaggaggtttattaagggatgcctttgggatggctgctggggaaggggagtaaatgaagcgggactggccagagggagacatgcagctgagatgcaggctcaatgacagctttggctgaccacattgggagggaggtctggagctgaaatggcctttctgagttgtcttgggttgggatgaaatggccaggcctctatgttcctccatttgtccttcatcactaggaatgtagcttggatgagatactctctggaactgacacagttcagaagggactaacagtaaggggctgcttcctaacgagctcccagaaactggggcaacacatccttccttgaggttgggttggggggttctgggtagtatacctgcatatccaccacattataattatttcatttgagaaatgtgtgtatgtatgtgtgtcatatataccccaagactaagaaatacatttccaaggcttagaggtactgctataatttttttccactgaattggtgggtaaattacctgaaagctgtgcatagccttgctagagaggcaccatggagacaagcaccttctctgtcccccaggagaattactgggagaaaacaaggtgttctacccaacacttgcagaaggaattgttaaaagtacattggactttattttcatttgtcatgtcctaaagccagagttcacagttgtttttttaaaaagcagagttaaatttccaagctaagatcacattattaaaaaaaaaaaaaaccttattaaaaaacacgttattaaaaaactaatctggttcttgacctctggtttaggtgattttttttttctggaaagccagtgagatttaagagaaactcattgttgccattaaaatggttatctttataatccaaataaattagaaattctttgaaaaacagacactggcaatattggagacagtgtcttcaatactcgaagtctctcctctggcttaggaacatgtgtaggtctcggtcagggtaacaatttctcctgtttttttcctcttgccattctcaggccttcagtttcctatggcttaggactcaaaatgatcaaagatgatatggattgcttagggacgctttggtagaaagacaattaagtttcttttctcttttctgtatcctttggattttctgagttcaaaagatttctagtacttttattagcaaagactcaatttcaaacaagaaagctacatctcataatagggagaattttattttactcacagaacatgaattatgtaaaaatctcagttggttctttctctctccctccctctttctctctccccctccttccctctctctctctctcccccttaccctcccccccttcccccctctctccccctctctccccctctccccctctcccccctctccccctctctcccccctctctcccccctctccccctctctcccccctctccccctctctcccccctctcccccctctccccctctctcccccctctcccccccctctcccccctctctcccccctctcccctctctctccctgtccttccctctctctctctccctgtccttccctctctctctctgtctccctgtccttccctctctctctctctctctctctccctgtccttccctctctctctctccctctctccccatccctccctccctctccctctctccccccgtccctccctccctctttcttctccctctccttcttttcttccttcattcctttttcttttcttttctcttttcttttccccttcttttcttctttttttttttttttctaacactcttgctctgttgcccaggcaggagtgcagtggcatgatcttggctcattgcaacctccacctcccaggttcaagcgattctcctgcctcagcctcctgagtagctgggattataggtgcccaccaccatgcccggctaatttttgtgtttttagtagagatggggtttaaccctgttggccaggctggtcttgaactcctgagctcagatgatctgcctgccttggccttggcctcccaaagtgccggggttacaggcatgagccaccatgcccagcccctttgcatatttattttatttttgtatgttctgttatttctgcctcatcttaggttgttagtctttttgtctttttgttgttgttgttgttgttgttcctgcctgtggtcttggtcctgtgtgttctcttcaattggagtactctgggtctgtgaaccataaaacttttctctgcacctcttgaatatcagaggggtaatgtcagatttcacagggccaatgtcagaaccaaattattcatatttaattctacctgccaactggatatgtctttcatatccatggcacccatctattttctttaaatcgagacataattcacagaccatagaatttgccattcactcatctgcttatgttgagttctttgtacagctttatttaaggatatttcagaattaagcagaagtggcagttaatgactagaatcctgggaggacaggggtagggcctgagattatctggctccgtggtcatctgtaggccagttggttaacctgctgggtcttggtttcttcctctgttaaatgagatgattttaatgaggtgacttttgagatttgtgccagctctgaaataatcctgtgactttgtgatggccattcagttgtgtaaacaaagtaaatcaactgtcacaacaggttaattagcactccatggcacgtttccagcagggatatcttcgtttacttttaagtggcaccgtatcctgattatcctgttgaaattgttatacagtttctgaatatttttttcctcctatgaccagataattagagaaaaggagtagtgtagaatgctatttgcgttgctctaaaaagaaaaccactgcatttttctggacaatgtatatatgtatgtatctagctggctagacaaataattatatctgttgagcctaaagcttatcttttttggagttgtgtcaacttggattttcttctacaataaattaactttgtcatacctggtcacatgaaataatataaaaaatccattgccccgtatttgttcatttgctccctaaattttcctgggaacaatcttctgtgttttttcagttgcggttttcactaagtatttgtgacccacttgtgttaaaagatataagctccaaagtatcacattgtgccaccagttgagatgtgcattcttctgaaagtgctcagaaatcagttcatcttgagtagtgttaagtggctttctatctgccttagatactttatttccctcttctcacttggccatttgttgactgattaaatgtttgtatcattataaaagatgttttctggaaggccaagccacaagtctcattatgaagttcgctggtacaaactcagacatatcatatttgctgcaaagaattaatttataaaccctgtgctgctgttgaccagctttgccacctgctgtgagccataaataaaaataagtgctggtgtaatgagggaccttggcttgtatatctttcttggccttcttggacctttggatgccttgcatggggtgcctgcggaaaagaaggaaaatatagccaaccccaaggctactttatctattaaaccttggaattttttagtagtttgccattagcgtacatagtccacaggtattgcgtagcttcatttgttttaatattccagctgtggaggagccagctgaggagcaaatcctaggtgtccttagttagtggccatgattgaagccaatggacaattgagtggaggctctgacatgctctgctcctgggctgtcctgaagaatctaggaagctgtttgcagatgggccttgcactgtttattcgtggagagctttatatgtgcagcccactgaaggaagtccgacattttaggcctgcagttaggatgttctacgtgaagcatctaagagtcacgattgggggtttttagccttttaggggtcacgggacccctttgccagtctggaggagcctatgggcccttcccagaatatgttttaaagcaagggtcctcaacccctgggccacccgaccgggccgcacagcaggaggtgagcagcgagcgaggaaagcttcatctgtatttatagctgctcccccattgctcgcattaccgcccgaacgctgcctcctgtcagatcagcagcggcattagattctcataggagcataaaccctattgtgaactatgcatgtgagggatctagtttgtgtgctccttatgagaaactcatgcctgatgatctctcactgtgtcccatcattcccagatgggaccgtctagttgtaggaaaacaatctcaggggtcctgttgattctacatcacagtgagttgtataattatttcattatatattataatgtaataataatagaaataaagtgcacaataaatgtaatgcacttgaatcatcctgaaaccatcctccctgcccctgcccacctggtccgtggaaaaatttttttccatgaaaccagtccctggtgccaaaaaggttggggaccactgttttaaagtgtttaaatacaaagaattacaaaggagacccttcatatcaaaatacagttatcaaaatattttaaagttatatataattatgtgcttctttactaatgtcttaaataatgagatcaaacagcagatcttaaaaactgtcataatatttggagtagtgatgggcataaaagttattctgagatctccgcaggaactgtaatgtgatatgaaaaagtctgtgactcctgttaccaacaaagtctcaagtctcaagtctactactagggtatgttacctacattccctaagtgagggaaatgttatgtttcagttgagggcaaatgatggcaatgatgtaatttttttctctttcaagttcacagacccccccccccaacctccaagaatgactggatctcaggtttagaactcctagtcccttctagaactattgcacatagagaatatttgtgcaaaaaaaaatggccatgattaagcctctatcatctaatgaggctgacactattatcatctccctcttaaagatgagaaaactgaggtttagatagatgagtacatttttcagggtcatccatttaggatgggatggagctggaattcaatccttggccctctgaattctttactacattgctatgcttgagttgagatgatactttgtttctatattgataaagtatttcttgttcaccacacttcacaaatgtgaaaaacaatactatccagttcagctgagaggacgaataaattagcatgcccttatacactgtgggtgggagtgtaaattgctccatcctttatgacagcagtttggtcaacatatattaagaaccttaaatttgttctagtaattttactcctgggaagatatccttaggaaaagatcacagtacaaagatgccatatgcaaagatgttcatctcagtgacacttacagtaaggaaatttcaaaacaaacaaagttaggcaatagaagaatggttaagtatcctatatatatttaccagatggtgtattaggcaggcatttaaaattatggcacttaagactatataattaagcttttgtaatgagtccttattaaaagcacctattatttaattgagtgatgacataggacagtcttttcatggtggtgatatttgtagatggtagtagttctggaaatggcaattgctaggtcaggaactaaaacctttagaggaaaaattcctccgcttcctatccccacgctgtcagagactagtggcttttccttgggcctctgacttcacttactatatcagaatcaccgttttggaaatatttggagagtgtttagaataggactttacattttaatgtggttagcatactggttcaaatacctctttatgtaggaaactaaactgcgtttgttaaatttgttttaatgagctggattcttgagatgtttccacttataaatgtaacaactacaaatagctgatcctagtttgctattgaacatgtgttatggtaatcattgtttttatttttaatttctggtctcttgaccaacaagagtctgaatgtgttccatcacttgaagatgtttaggtttattcttcctctttgtaagaacaaaagtactgtacttaagagcttgtgctttcacttggaagtctattaattcctttttaaaatgtagttgttagtcccaatttctgccaaatttcttaaactttctggaagactttcccaaaggaagtatttttaccttcccaaagtctccggattcctgctgtctcctcagtcctgttcattaaactcactcaactggtttcagagttcatgcatttcttttctttctccttatttttctctaactatggctaaacgtttgctccgtggatcagatcctctgctgactggggggtagacttcatcagtttctgctgctagtgctctgccttcttgaacagtatttctttttcaccaaagaacttgtgatggcatttaccatgtttgtcaaaatccagtttttcacacctcattatttaggatttgatcagaactctggggcaaagttgactcttgtaatatttgggaggactaggtttgctaaaggaataacgtcaaaatttcagcagaaatgtttgttttggagacagttgtaagacatataacaattctttacaaataggttagattcttgtatcttcaatttacctacctgttacagaagctcagggttatttaattgtaataagtatttttgtattatgtcttttaaagaaacagaataaaagagaatgtaggtagggggagagagagagttatattaacctttttatttaccatttctgatacttttcatttgttcctgtggattcaagttaccatttggtgtcatttccttattccaatatagccttgttcctaccaatatccttttgctgttattttcaaatgtattacatttctgtataagccgcaacacatgattataaacatcattttctgcaactgctttttaaaccagttaagagaagaaaagaggaaatttgcaattatactatcttttataattgcatgcataactacctttactggtattctttgttttttatcacgtgaattcaaattactatctggtgtcatttgctttcagcctgaagaaatttctttattattattattattattattattattattattattattatttttgagacagagtctcgctctatggcccaggctggagtgctgtggcgcgatctcagctcactgcaagctccacctcccaggttcatgccattcttctccctcagcctccggagtagctgggactacaggagcctgccactacgcccggctaatgttttgtatttttttagtagagatggggtttcactgtgttagccaggatggtctcaatctcctggcctcgtgatccacccaccttggcctcccaaagtgctgggattacaggcgtgagccaccgcgcccggcccctttagtatttttgtaagatgggtctgctagcattatctcagcttttgttgatctgaaagtgttcatatttcatcttcatttttgaaagatagttttagtggatataaaattcttggctgactttttttttctttcagcactttgaatatgtcatcccgtggccttcgttgtttctaatgaaaagtcagacattaatcttactggaattctcttgtatatgacaaaacatttttctcttgctgctttcaggattttcactctttatctttcaaagttaactgacacatctgggtgtggacctctttgcctttatcccacttggagttcatttggcttcttggatatgtagatttaattttttaaaaaatgatatctggggccgggcacggtggctcatgcctgtaatcccagcactttgggagaccgaggtgggtggatcacctgaggttgggagttcaagaccagcctgaccaacatggagaaaccctgtctctactaaaaatacaaaattagctggtgtggtggtgcatgccttaatcccagctacacaggaggctgaggcaggagaattactttaacctggtagacggaggttgtggtgatccaagatcgtgccattgcactccaacctgggcaacaagagtgaaactccatctcaaaaaaaaaaaatcatatttaggaagttttcagcaattatttctttgagtatttttctgctcctttctctcctcttcttctgggactcatattaggtgtcacatatgttggtgcacttaatgctgtcccatgttcctttaagactttgttcattttttctttttctgtcttgttcttcagattgcatatctctatttttctatcttcaagtttgctgattatttcttctgccactcaaattgcctgttgagcctcctgagtgaatttttcattttggctgttgtacttttcaacttcagaattcctaccccccctccttttttttggtaatttttctttatcttctgtgtttgagatactgttataataccttcctttaattctttaagtatggtttcccttagttctttgaacgtatttgtaatatctgctttcaagtcattgtctgctacatttaatatctgggtcctttcaaaggcagttagcattgcctactgtttttcccatatgtggatcacactgtcctgtatttgcatgttttgtattttttgttgacaactggacatttcagataatatattgtagaaactccagatactgatctttctcccttctgcctccggggcatgttgtttttgttgtttacttgtttatttgtttcatgacttgactagttcagtgaagtctatttttctgcaatgggcagcctctgatgtcacttctttttttttttttaatttaagttttagggtacatgtgcacaacgtgcaggtttgttacatatgtatacatttgccatgttggtgtgctgcacctattaactcgtcatttagcattaggtatagcacctaatgctatccctccctgctccccccaccccacaacattctccggtgtgtgatgttccccttcctgtgtccatgtgttctcattgttcatttcccacctaagagtgagaacatgtggtgtttgattttttgtccttgtgatagtttgctgagaatgatggtttccagcttcatccatgtccctacaaaggacatgaactcatccttttttatggctgcatagtattccatggtgtatatgtgccacattttcttagtccagtctatcgttgttggacatttggcttggttccaagtctttgctattgtgaatagtgccgcaataaacatacatgtgcatgtgtctttatagcagcatggtttataatcctttaggtatatacccagtaatgggatggctgggtcaaatggtatttctagttctagatccctgaggaatcgccacactgacttccacaatggttgaactagtttacagtcccaccaccagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgtcttttggctgcataaatgtcttcttttgagaagtgtctgttcatatccttcgcccacttgttgatggggttgtttgtttttttcttgtaaatttgtttgagttcattgtagattctggatattagccatttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaaaggtattgcctaggttttcttctagggtttttatggttttaggtctaacatgtaagtctctaatccatcttgaattaatttgtgtataaggtgtaaggaagggatccagtttcagctttctccatatggctagccagttttcccagcaccatttattaaatagggactcctttccccattgcttgtttttgtcaggtttgtcaaagatcagatagttgtagctatgcggcattatttctgagggctctgttctgttccattggtctatatctctgttttggtaccagtaccatgctgttttggttaccgtagccttgtagtatagtttgaagtcaggtagcgtgatgcctccagctttgttcttttggcttagggcattcaattaggaaaaaaggaagtcaaattatccctgtttgcagatgacatgattgtatatctacaaaaccccatcatctcagcccaaaatctccttaagctgataagcaacttcagcaaagtctcaggatacaaaatcattgtgcaaaaatcacaagcattcttatacgccaataacagacagagagccaaatcatgagtgaactcccattcacaattgcttcaaagagaataaaatacctaggaatccaacttacaagggatgtgaaaggcctcttcaaggagatctacaaaccactgctcagtgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatgatgtcacttcttaaagggcacactcttgggcatgcgcacagttattctgactcttgtatcctcacccaggaatgacagtagttgcagctaggctctctttgactgtctgtttccctgatctccctgttaagtttctgactaatcttctgtattggtcttacacaactggtactacactgagttgttagtctccctccttagctgattgttctattgcttttgacaataccttgaggcataattgttccacagtttgatacaattaaagttttgcaggaatagtccttaaaactaatccctaaggcttggtctgacctcaggaaggttcctcctagctgtctctttcccatttctctctgttaaacttctagctggtctaccctttacatattcctatcacagagctaccagccttctcttaattgccagccaccaaaatctccataatgttttgtacagcactcatgagcttaaacttccccatggcacattctgcatgaagtcactctccttgtgaagagctgcagttcttacagcctgcctttctcctggtcagagctctgtaccactgctgtggagatggcagtggaaacagcagtctgtttctcttggggtgacactctgctctgtgagtggggtgctggctgggggcaacagcctctagtcttctcagcttgcctctcttggcatagaaccttcattctgtgagggagctggggcagggacaatcaagtttcagcattcttggcctgttttttgtttgtttctttgtttttgttttgttttgagacggagtcttgctctgttgcccatgttggagtgcagtggtacgatctcggttcactgcaacctctgccttccgggtttaagcaattctcctgcctcaacctcccacgtaggtttcactgcaacctctgcctcccgggtttaagcaattctcctgcctcagcctcccaagtagctgggattacaggcgcctgccaccacacctggctaatttttgtatttttagtagagagggggtttcaccatgttggccaggctggtctctaactcctgtccttgtgatccatccacctcggcctcccaaagtgctgggattacaggtgtgagccactgcgcccagtctcttagcctgttttgcctagggtagagcttctaccctacaggtgtaggctgggtagagcaagggagccctggtcatcttgaccacacttgcctggaatagagcttctacaatatcaggctgcgaggaataagaatgttggtggcctggtcttctaaggagaaacagtgactctggaccagggacaagagggagcccttttgtcttggccacacctacttagagtagaacttcagtcagtctgggctgggtgtgggggcgggggagcagtttatggcccaaatgctgcagaatcttactaacaagatttagattttcttgaataaaatgtttttccatttgctacatgccctcaggacaacttatagagactttaaatcaggggtgttcagtcttttggctttgctgggccacattggaggaagaagaattgtttgggccacatgtaaaatacactaacaatagctgatgagctattaaaaaaaaagtttgtgtgtaaatctcataatgttttaagaaagtttacaaatttgtgttgggccacattcaaagccatcctgggccatatgtggtccatgggccccggttggacaagcttgctttaaatggctgtttaaaaagaattttcatcagttatggttgtctttctggggataggatctgggaagctccttacacttccagtccaactttaactttttgaaaataacaaatgatgtttcttcaaaggtatttttccttctagacctcactgatctacacagtccttttctccctctgtctgaactaggaagtctttgaccataacatcaaccaatttcaggtgtgtattagtccattttcatactgctataaagaactgtccaagactgggtaatttgtaaaggaaacaggtttaattcactcacagttcagcatggctggggaggcctcaggaaacttacaatcatggtggaagggggagccgcaggcaagataccttcttcacaaggcggcaggaaggagaagtgcctagcgaagggggaagagccccttataaaaccatcgggtctcatgagaactcactcactatcaggagaacagcatgggagaaaccgcccctgatgatcaagttacctccacctggtctctaccttgacacatggggattacggggattacaattcaagatgagatttgggtagggacacaaagcctaaccatatcaaggtggaagaaagaaagtttaacttttgaatatgtaaatggcatttaatttagtctaggaacatggctttcttggcatggatgagggagaaatttacctctaacttaccaaaaccttaatgctgaatgatttgagtctctttaagaacttgaaagtattacaaggccaggtgcagtggctcacacctgtaatcccaaccctttgggaggccaaggcaggaggatcgcttgagcccaggagtttgagactgcagtaagctgtgattgtgccaccgcactgcagcctgggtgacagagcaagaccttgtctcaaaaaaagaaaaaagtgccacagggaacagagagtctttgttcctgtggggtaggcaattcctagtggctgtgaagaagtagataggagcctgctaccccacttatcacacacacacacacacacacacacacacacacacccctacacacctgaatttttaccctttctacttacaacactggtatttgtgggttttggttttgttttgttttgtttttgatgtagtctcgctctgttgcccaggctggagggcagtggtgcgatctaggctcaatgcaacctccgcctcctgggttcaagtgattctcctgcctcagcctcctgagtagctgggactacaggcatgtgctaccacacccggttaattttttttttttttttttttaagtagagatggggtttcaccatgttggccaggctggtctcaaactcctgacctcaaataatccactcgcctctgccttccaaagtgctgggattacaggcgtgagccaccgcgcctggccagtatttgtgttttgacagacttaataccaatagctggtacccacaaggatggtctccagctgctgctttgcagcaggatgtaagtattctcagaaaaccaaccctattttcagggataatagaatatcagaagctttgtctaagacaacattgactcgtcacctgtttctgtatgtcctgggagctaagaatggttcttacacttattaatggttggaaaataacaaagtaagatgatgatttcaggacacgtaaaaatacgaaatttaggccagatatggtggctcaagcctgtagtcccagcactttgggaggttgaggtgggcggattgtttgagccctgaagtttgagaccagcctgggcaacatggcaaaaccccaatctctacaaaataatagaaatattagctgagcatggtggcacgcacctttagtcccagctactagggaggctgaggtgggagggttgtttgagcctgggaggttgaggctgcagtgagccatgttcgcgccactgcacttcagtctaggtgacagagcaagaccctgtctcaaaaagcagaagagatctgagactcattatattaatatatgcttcctacaaaacaatttttattccacaaagtttataatagctcacctatagttaaatgatcaaataatatgcctttttcatctatgctgaaagaaaaaacaatatgccatgttgcaatccttgcttatcaggaggttcatgttccctctggttttgggcacatataatgaaacaatgtgatttctgagatttaaaaccctaaaatttctgccagtgaagttcagagatacatacagatcagttcagtatttgaaaccaaatttttgtcatatatctacgtggtagagcttttgaaatcgagcggtttcctgttttgtgcctaatagatccatagtcgtattgaacgaattgttttcatcctcaagtattttctccatgcctgtcccaccaggcgccacctgcccagagcctacacttccacataagttactttctggaacatctttgtttcttttttccaggcatccagtggaaattattatttcatcccatacatcgtgacaccgtgcgctgattatttttgctgcgagagtgatgcccagagacgagcctccgagtacatgcagcccaactgggacaacatcctgggcccgctgtgcatgcctttggtggacaggttcattagcctccttaaggacatccacgtgacctcatggtaattcccatctgccaccagtaacccctggagactcaccaagatgtccccatttctttcagggaagcggtacaccttcaaatgaacagagttgctggagaacccactattgtcccttactggctcacttagctgggccactgaaatgaaaccaaaagagaatagaactggagttaagaagtcgggattgagcccgtgtctggccctgactccctgtttgatcttgacatgtaacttctcttctctctgattgttctgtctcttctagataagacaacttataggaagttgtcagtgatttttttttttttaacgatctctttcagctctgagatcctgtgtttcaagatgatttctgagcatggctttacactcgcgtggctgttggggctcttcatatatctcagcaaggtcattctgaccttacgctctcgtgctttaaaagccttcgtgcgttgagtggagctgcagctatcctcaggatgtactgtgctgtgttctctttagatttaggttaggtgaggtgaaatatgcagaagtgaataggtttagattggaatcttggcttagatgattcctacctgtgtagcactgaaatagtcagctcacctattggagcctcagtgctcaagaaaccataccttcagatgttattattgtgaaagtaaaagaaaaattattcttcttaaccaaaggatccagttattttgcttgcagccaatttaaaggatttattcctgtaagttgtgtcacaaggagaaggatttgtccttccaaaacaaatgaaaatcccaaacactggcagagctgacctgaaatgaaatgtagaggacctcctgtcacactgtggctcaaatagtggcaccctgaactgcggagtgttctattgtagtgttggtacaagggagacacttattaatggtctccttttctatcccgtcacctcttccctggatacagaccttcttctacagactttaatggaaaaggagattagaaacctaaacatgtgtgaccacatgccaacacagagagcaaatgggggacattttgtggcacattcctggaaaacctcatgcagtcatgccttgctaactgttgtctgattgcaaaacaaacacttgagtgaagttttatagaaagctctcccaataccatattttcaagtctgacaaggaggtagactggctagatctgccagatgatttaggtctttgcaagacatggattcaagtttgtttctcactcagtgtgtgtatgtatcagtaggcaaacaactcttgtgatttcatttagtttcaaagggcttgaaatacctattggtggattccaccctctgaactggcagtgtctgacaacagttagtaggaggggaagtggtgcttatagtttaaaacatctataacacagatggaaaggaagttttgagctcaagcgccagctctgatagatttataaagtctattttgagtcctgtgctggaatggcttggaagccatttccaagtgctcattgatcagcaacatcttccttggttacaggggcagaaatggctgcatgcttattacatatctgatgtccccaagccatactcaaaccagtgtttaatttacctaaaaggtactgttcttcttaggtttcttagtttattaaaattatttttcagaattacccttgaaaaataaggctgaagtataactttttacttatcgggctaacctaataacactttaatagcttcagtgcctttatagtccaccaaatgtgcaatggctggcatccaacttaatgactcattcaattagtgacagaattttaaacactggcagaatctgctaattttgttcattattgggatgatggcaattaacaaaaaaggaaatagaaaactaaagcaatgcattgatatttttctatcagaacccctgctgtgtgcgtcacttcattctttaaatgttaatggaggtcctcttgtgagcattggaccaggttatgtactgtatgtacacatatttggcattgttttgtaattattgaaagtaggcaccatttgttcttatcgtatctcatgttgtttttctctctttgaagactattattaaatttagcttactctctttttaatgaacagcctaattttacactctgcagttagtccatttcagctttgttttgtgtgtgtgtgtgtgtgtgtgtgtgtgtgtgtgtgtgtgtgtgtgttttagaccaagtctcactctgtcgcccaggctggagtgcagtcgtgcgatctcagttcactgcaacctctgcctcccgggttcgagcgattctcctgcctcgacctccgaagtagctgggattacaggcacccaccaccaagcccagttagtttttgtatttttagtagagacggggtttcaccacgttggccaggctggtcttgaactcctaagctcgggtgatcctcttgccttggcctccaaaagtgctgagattataggcctgagccactatgcctggccccatttcagcttcttaatgggacgacagtattactgcttggcagtgtcctacctccacttaaaaattcctatggaaaatagacaagatattttaaatcaatctatggttgttgtaactcaacttatgtataccaagttaggtcatttttcaaggttttaaaccaaataccagataatagcattggctcttcaagagactatggtgatattccagcgtgaatttaactgctttaagtgtttttaagcttcctcgtgcttatctagctgctcacctgagggaagttttgtgttttccattagaaaactattcttgggtccaggcatggtggctcacgcctgtaatcccagcactttggaaggctgaggcaggtggatcacttgagtccaggagtttgagaccagcctggccaacatggtgaaaccccgttctggctgggtgcagtggctcacgcctgtaatcccagcactttgggaggccgaggcgggtggatcacgaggtcaggagatcgagaccatcctggctaacatggtgaaacctcatctctactaaaaatacaaaaatttaactgggcatggtggcgggcgcctatggtcccagctactcaggaggctgaggcaagagaatggcatgaacccaggaggcggagcttgcagtgagccgagattgtgccactgcactccagcctgggcgaaagtgcgagactctgtcttaagaaaaagaaaaaaaaaaaaggaaagaaaccctgtctctaatagcaatacaaaaattagccaggtgtagtggcacatgcctatagtcccagctacttgggaggctgaggcaggagaatcgcttgaaccagggaggcggaggttgcagtgagctgagattgcaccactgcactccagcctgggcaacagagggagactccgtctcaaaaaaataaataaaaataaaaaaaaaaaaacaaaaaaacaaaaaaacagaacatctggccattcaatatggtgaggagagcaaggctgtctgtaagtttccaggcatgacctctgtgtgtcccatcttgtattgctcagggactcaacaccagtttccagccctcacctcaattggggaaagcttcatgactactaatgagagacacctgatagagaaattcattttcaagtcattctcatgtatgtttcatgggttttggagctccgtttggctttgttactagtggcgaaaataaatacacaaggaaggtaacttctcaccctctatatgtttgaaaatgccggagacagtgggtttggttggctgcaagttctgtgtgttgtccaagtacagatgggagtcacctttgaaagtatcttcaaggttgaatgaactgatttttacttgtcattcattggtctataaaatgtgaataagtagaaagcatcttctgtttgctggtgcagggaggctcaggtctgggccgaggtccctatgtgttagcctaagtcaggtcaatgagaaccattttgggcgcaagacagtcctgggtgcgtgcagatgtgactggaggattttgtgtttttctttctatagtgtttattacaaagaaaccttgttaaatgacatccggaaagccagagagaaataccaaggtgaggaactggcgaaggagctagctcggatcaagctccgcatggataatactgaggttctgacctcagacatcatcattaacttactcctgtcctaccgtgatatccaggtatgaaatccacctagccgaggctcacgtatgctacgttcttccttggcttgaggaacgtcttgtgaagtatttgtatactcagtatgtggtgaagtggctgggttttgttcttcttttttgttttcttttttgagatggagttttgctcttgttgcccaggctggagtgcaatggtgcgatctcggctcactgcaacctcagcctcccgggttcaagctgttctcctgcctcagcctcctgagtagctgtgattacaggcatgcgccaccatgcccagataactttatatttttagtagagacagggttttcaccatgttggtcaggctggtcttaaactcctgacctcaggtgatccacccgcctcggcctcccaaagtgctgggattgcaggcatgagccactgtgcccggccagaggtggccgttttatagacaaatggtatgtggctaggtcataggtcatccagcttatctgttgtggtggaaattttggagaaggttttgtcacatcggggctggtgtgaccactccgacaagaagagatgtcataaacaggactgtttggcagaaggagccaagaatttaagtttatatgaactttacactaggcattgtaccaagccctttgacaaacctgaattcatttaatcctcttaacaaccctatgtgggatatgtgtactctgattatccacattttacacatgaggaaactgaggcacagagcggttaagtaacttgcccgaggtcacacagcagttggttaggtcaggattcagactgagactgatgctccgttgtccttgttcctaacccctctgctgtgcaacttcctttaggcttttgtcacttcctcctttgtttaccaccatacatcagtgacagggagaacaggagtagcagaaacacattcaggacccagggaatgtagatgtttattctgagacaagcatcagaagctactggagagttctgagactggtcttttggtctgtggttccgtgaaggaaattgagcgtttcctctctccaagttgaatgccattgagccatctctaaggatgtcttggcttcctttcctttggaggaacacaggatcacgtaccttactcatagaattccacaaagccatgttgagagttgttggctagaagtctttaaattgaagtgatggaggcgtccacttatgacctggaccaaaacagagtcaaccagtaaggaactcctgcccctggtgataaacagatgcagctagctgattttatttctgtttttcaaatttttatttatttatttatttattgagacacagtcttgctctgttacccaggctggagtgcagtggtgtgatctcagctcactgcaacctccgactcccaggttcaagcagttctcctgcctcagccttcccagtagctggaattacaggtgcctgccaccttgcctggctaacttttttaatttttagtagggatggggtttcaccatgttgggcaggctgatctcaaactcctgacctcaggtgatccatctgccttggcctcccagagtgctgggattacaggcgtgagccaccgtgcctggccagctagctgattttaatagcagttgctactagggatgataatgattaggtcttgtctcccaggacaagaacatgggaatgacttttcttgaagcctttcttccctcgagctgctgctttttgtccttcccttcatgtatcccttcttttcataaccttccattcatgctcaaaggtgggccaagaggttcttggaataccctgccttctccctcctggggcagcagcatcaaggcgcagagccacaggacaggcatggcatttcagtgggaagccctgttctgctgaccatggctggctgtcagcaagttggccagttccaacgattctaagcctggctgaaagagtaacaggcggcactgctaagaggggacttggctgagacaagcatggtcgcaatttttctccaggtaattatgcagagtttagagcagtggttctcaacccaaggacttttttggcagtgtctggagacattttcagttgtaaaaactaagtgcgtgtgtggggcatgaggtgggtggtgtgctgtggcttccagtgggtcaaggccagcatcctacagtgcccaggacagctcccacaacagagaattatggtccagaaacgtcactagtcccaaggttgagaaacactagtttagattaatgtatttgattctggcaaaataggaaagactggaatctatgtgctttgactggaagtttgcttgtgtgtatttgtccagctcactttaacacacatctctgctgatactgtttttttattttgtttttgattttgagacagacggagtcttgctctgttgcccagcctggaatgcagtggcacaatcttggctcactgcaacctccgcctctcaggttcaatcaattctcctgcctcagcctctcgagtagctgggattccaggcgcccgccaccatgcccagctatattttgtatttttagtagagacagggtttcaccatgttggccaggctagtctcgaactcctgacttcaagtgatccacccacctccgcctctcaaagtgctgagattacaggtgtgagccaccacgcccagcctctgctgatgttgttaactctcctacactcagctgtttcctggctgctggcctcatttacttttgttgcctttggatgcttcatgccctttgatagcagggattccttctctgttcttctctctctcatccatcttattttctggtctttttccctcctattaaaggctacaagtaacttcactaaatgccctttgtaaggaagggcctgtctttaagtgcggaggctgtctcctgtttataacaattcagaaaaatcagtgaagagctgtgtttcctctcttgctcactttgggacctcttgccaacaggactatgatgcgatggtgaagctggtggaaacactggagatgctgcctacgtgtgatttggccgatcagcataacattaaattccactatgcgtttgcactgaataggtaagaacgataatgtacgtacaggttttgaaacatgccacccattgaattgtgcttccttctttcattcaacatcgggtatgagccaggtcacgtgctaaatgccaaggttatgaagatggacaaggtccagtctttgtcctcagggactttgtatttggcatacacattctagctgtgagattgaacacatcaatccatcctaatagcttatgacggcatcaaaacaggcacccccggcttcacatatcttgtaacacatacgaggtcacatctcttttttaaatcggtaaaatttgcagtcagtgaaatgcacagatcttaagtatatgatttgtgtttgataattggctatacacatggaaacaacactcccatcaaaaaagaaaacatttccatcaccccagaagttcccttgtgctcctttgcaggcaatccttaacccctccataggtgaccactgttacagcctctgtctccatagatgagtttggcttgtccttgacttcacataaacggaatcacacagtgtgtactcttttgtgtcattcatcgtcgtgttcgcgagattcatctatgcggttgtgtgtattagtggtttgttcgttctcattgccgtcgcgtagtccttggtataggtatgccacaatcatctgttttactgctgatgggcctctaggttgtttgcggtttggggatactgagaacagcgctgctatggacattgctgtacatgctttttctacacatatggatacatttctcgggtatatagcatgtgcttgtagtagacatcggcaaacagtggtaggattctgattcctttttgggagaaagcttcatggtctctgtggaaatgcacctgctctctccccagcagcctttaaacccagcatcccaaggatgcattgttgtgaatgacggccagtcttcattaagcctgataaagtcttgtaactttgttcccccgacatagtaagctccattcttatttatatttacctgtgcttgattaataaccattaaatgagccatcacgcctgaggttcttgggagagtgcctggcacactgtaagtgctgtaaaaaattggtttgttaaataaaaactataagggccttttaagttactcatcactaagtctttttcccagacatagtagaggtaaccgttgtcagacagagaatgaaataatagattgccattttctcaaaataacaaaagagtaaaacaagatttgaaatggaaaattggggccggccgcagtggctcatgcttgtaatcccagcactttgggaggccgaggcgggcagatcacttgagctcaggagttcaagaccagcctgggcaacatggcaaaaccccgtctctacaaaaaaaaaaaaaaaaaaaaaaaaaaattagccaggcatgatggcttgtgcttgtagtctctcagctactcaggaggctaaggtaggcggcttgcttgatcctgggaagttgatgctgtagtgagccatgattgcaccattgcactccagcctgggtggcagaatggagaccctgtttcaaaaaaaaaaaaaagaaaaaagaaaaaaagacatagaaaattggtatttaggagaaacaggtatagcaggatgaggtgatcctgagatgaatacgtttcccgtttggaagcagaatggctgggattgcacaccagatagccacctttctctttgatgggtcttttccttctagtctgattatctcctgttagacagtggctctgtttaatagggccagacggggtctccaacactgagaacctcattttctccaacaaactaaggattttctatgggattgcaatacttgcttcatttacacatgtaatctgatcctgaatttcacatttttgctttaggcttaagttggccagccgtcaacatagtaggagtttgcattacacattgagcatctctaatctgaaaatctgaattgaaaagtgctcctaaatccaaaactttttgagcgccaacatgatgctcaaaggaaatgctcattggagcattttgtatttcaaattagggatgcttaactcgtaagtataatgtaaacattccaaaatctgaaatactgcaaatccaaagcacttctggtcccgagcattttggataagagatacctaactggtatatatagttttgagcgagtttatggcattactttgtatctgtaaaggggaaaatagtgatggacaagaaatgagttttcctgcatgaaggttgacctttagctctcaggaagtggagcaaatcatggccagaaatgagttactgaaggttggcagtaatggatgactttcgaccctcagatgtcaagggctccctgttagtgggaaagctggctcgagccggtcagctttccctgataccttccactccactgcgttcagaagcccattcaaagctacttcaagtttccactgagcagttaaactgcttgctgcttgatggcatggaatattttatgagtgatttgtatttgctgttgcttttacaaatggggctttattagatatatgaatgtagtcagaatattctgaccagggatccagccagtgagctggatggtctagaagaagaaaatcagaatcaaagtcccaggttcaaaacaaaatagaacttgccagtcgcaaaatagaaggcatgtgctcatattctacttccagcatctttggatcgagactaccaactctggcaaaatttacctctttgaattactcagcaagtggcagggcagttggatgtgtgacgcactgactggaatgtctaatatgtcgttctgtaaataaggggagtgctagatgagaatgctctgcagaccctagaaatgtgtgcaggggacatgagatgaacgtgactgaatccagcccacaccagaggggctgcatgcttgttccagaacctactgtattcacctgagccttagtctctgagcttcccagccgagagggcagagtgagctcgtcatctctacagtagccacgagcctccttttgtctcttctgttgatgttcgctgtttgatttcgctgtcttaatttccatgtggatataagtagcattctttatgacatgtttgtcaaatgtagaaaaatgatgacatcttcccacttttctaatgcattgtctccaggctcctaaaagcatcttgtgaaagaaggatacatacttgttgcttttctagtgaagagaaccacaaaatctgccaacttaaaaggaatcatttagtccaaatcctttgttttggagaggagaaagaaacaaacaaagaaaaaggcaagggcccaaaatgtaacacttggtcaataagagatctggaaccagaactccctccctaatgttaccacagcacactgcatatactacttttttttttttttttggcctgagacgctcactctgtcgcccaggctggagtgcaatggcgtaatcttggctcactgcaaccttcgcctcccgggttcaagcgattctgctgccttagccccctgagtagctgggattacaggtgcgcatcaccacgcctggctaatatttgtattttagtagagacgaggtttcaccgtgttggccaggctggtctcaaactcctgacctcaagtaatccacccgcctcagcctcccaaagtgctgggattacagacatgagccactgtgcccggccttggtttggtgtttattgtagcaaaaaaatacatataaaatttaccatcttaaccacttttaagcatatagttcagtactgttaaatatgttcacatatggtgaaacggggctctagaagttttcattttgtaaatctgaaactatgcacacattcattaaacagctgcccgttgctcccttccccagtccctagcaaccaccattcttctgtttctgtgactgtgactatcccaggtacctcatataagtgaaatcgtacagcactactgtccaatcttttggcttccctgggccacattggaagaagaattgtcttggaccatacataaaatacactaaccattgctgatgagctaaaaaaaaaaaaattgcaagaaaacctcataatgttttaagaaagtttacgcattggtattgggctgcattcaaagccatcatggaccatatgggccgctggttgaacaaccttgtacagggtttgtctttctctgactgctttatttcacttagtgtaatgtcctcaaggttcattcatggttgtagcatgtgtcagaacttccttttcaagggtgaataatccattgtatgtacagaccacattttgtttatccattcatctgtcgatggacatttaggttacctcttgagtattgtggatagtgctactattaacatagtgtgcaaatatttcttctagaccctgcttccaattcttttggatatatgcccagaagtaaaattgttggatcatatggtagtcctatttttaatttttttctttttctttttctttcttcttttcttttcttttcttttcttttcttttctcttttcttttctctcttctcttctcttctcttctctttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctctgacagaatcctgctctgtcacccaggctggagtgcagtggcatgatcttggctcactgcaacctccacctcccaggttcaagtgattctcctgcttcagccacctgagtagctgggactacaggtgcacaccaccacacctggcgaatgttttttggtagagatgggattttgccatgtttcctaggctggtctagaacccctgacctcaagtgatccacctatctcaacctcccaaagtgctgagattacaggcatgaaccaccatgcctggcatatttttaattttttgaggaatctgtaaattgttttccatcgtgcctgccccatttacatctcaccagcggtgtacagtttctccaatccttgccaacacttattttctgttttcctttttttttttattagctgccctaatgcgtataagatgatagcctattgtagtttcaatggacgtttctctgattagtgacactgagcatcttttcatctgcttgttggccatttgtatattatctttggagaaatgtctattcaagttctttgcccaattttttaaaaggttatttgatttttgttgttgttgagttgtaggagggtttttttttttatatatatatattctggctattgactcccgatcaaatatacaatttgtaactgttttcctatattgtataggttgacttttcactctgttgattgtatcctttgatgcccaaaagtttttaagtttgatgtctcatttatctgatcttcttcttttttttttttttttggaaactgactctgttgcccaggctggagtgcagtggtgtgacttccgctcaaggcagcctccacctcccgggttcaagcaattctcctgcctcagcctcccgagtagctgggattaccggcacccaccaccacgccagctaatttttgtatttttagtagagatggggtttcgccctgttggcaaggctggtctcgaactcctgacctcaagtaatccacctgcctcggcttcccaaagtgccagggttacaggcgtgagccactgcacccggccggatgtctcatttatctaatcctgctttgttgcctgtgctttcaatgtcatacccatgaaatccttgccacatgtatactttttataacaaaaagccagttgtattttttttttttgataaatgaaccatcttatcttctgagcagtggccttgccaataatacatgttatcttttaaaaaaatatttgcttaaagggctctgtcttcattgctcctcactggcctccttgagcccgtgatatcttccttttctgtttccttcttcagttccctcctttttgtccttcctcctttatttactaacttatttatgtgtcagtagaagggctgtgtgtaaaggaagagggttcatgaggggtgactgaagttaacaggtgattttttaaaaaatcacgttttcaagtccaacagagcttaaaggtaaaataaaaataaaaaattacacgtgtatatttctctctcacacacacctgaacttatacaaacaagtgaatttgtttgattcaaatgaatttcactgcagtgttctgcattgattttggcaatgctgcctttattcagaatattatggcatcagtcagagaggaatttttttctttggaattgccagctttctttatttttttcgtctcctctcccttttctcctgtcctcttctcctcctctcctctgttgtccaggctagagtgcagtggtgtgatgatggctcattgcaaccttgactttctgggctcaagtgatcctcccacctcagcctcctaagtaggcacatgccaccatgcccagctaatttggaattgctagctttcaaggcacataggaaatcaatatcattccaatgggttctgaagacagatttgggttccagttcctgcttctgtactttattgttatggccgtggtcaagtaatttaacctcctcaaacgttggtgtccccatttataaaatgtgatactgacatctaccatgtagtatcacttggagtactcctggcacgaagcaggtgcttggctattgctcttactattactgtgtagcttgatcacccatattttttctaccaggtttgagggataacttttgaccatttccaaataccaaaactactagcaaaatacagagattgccaccacagacaatatttaaaataacatacctttggctctgaaaaaaaattcttaagagaaatttatagaagtgcttttagcaccagaacatcgttctaataagtctctggccctctgagatgactattttgcgtgggacagggttgatctgaatataggtatttgcagaaaaaagcgatcgtttggtaaattcaaagtttattgatttagagtgggtttcttcaccttggcactattgatatttggagctggataactctctgtcatgggggctgtcctatgtatagtaagatgtttagcaacatccctcgtctttacccactagatgccaataccactccccccgcacctcacccaatgtaacaaccaaaaatgtctctagacattgataaatgtcccataggggacaaaaatcccttctggttgagaccactgatttacagggaggcatttgaggtatagaaaaagtgcacgctttgacatttgcatcaccaacaatatgatgttgtcaagctaattaaactccttcagcctgaatttgttcatctgtaaaccaggatggtgatgcctaaataagatatgccatatgcaaatgactgcacggcccctggcagctagaaggcagttcataaaagtttgatagctcctccatttatccctcatttacacttcttaattctaatcgggagataacctagtgttacataaaaagattacagagtcaacagggcgagtgccaagtggcttagtctgtaggaattatggttgcttaaagtagacaagaaaaactgcttgtaatgtggccaaaaagtggcccagagctcttaactggctgttggtcacccagagagcattcaacttggggaatggtttgagaaatactccaaaactgctctactgtttacaacccacaaaactgtggactggactgctgggaaaaaaaagtagaatggtgggaattaatttgaggctttaaaaattaaataatatcataagtaaaatattagcatagtgtctggtgcctagataatgttggatgaatgttaattgcccttctatttcccaccagagaattccaaccaccagtgttaggtcatctccaatgatagtctgaactgaaaacaatgttatgaccaagttttctatcagcctaagaaaatgcaacactgagagagctaagactaatgaatacaatgcgtaaaggactttaaaataaaatttttccatacctgacatcaaattttttcatcaatgagatttaagaacacagttccttatgtttttctcatgtataattttttttcggggacagggggggaccttcctccagtggtttaaggtattttttcccccataacagtaaagtcaaatacaggagacattgttttaacatatctttgtgactgggcatccagaaaattggttaacactgttaacagccctgccaattgctcacttgattgttttgaggctcatggtagcatgtattgcagttaccagcctcagatatcagttgaggacataaggactgggaatttatttgtaatacattttgacatgcagggtaaaccgttaattattaaccattcctgaggaaaatcctgacccatgtaagttgctaccagggcctccgcttggcactctgaatcaatcgcatgtggacattccctgttagctgcattgtgaagtcctcgttgccacgttgagtcaggaagaccaaactggaagttcaggagacactaaccctggaaaagctgccttctcgcccgctgcctgaggatttcaaacaaatgagaaaagccacagttccacttaggaaacattgactttcctgtagattcagcctcctacaccttagagcgggtgttgagagacttcacatgcgttcatccctgtcgctgttgtccttgagataaggacattgataaagagaaggtgggagacatcctttcagattttcgtgggtttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgcttttagccgggatggtctccatctcctgacctcgtgatctgcctgcctcggcctcccaaagtgctgggattacaggcgtgagccaccgcgcccggcctcgtgggtgagtttctaaagagacagaagggccactaaatcaaccctgtataacccccttctaaattcaggatggcaattcacattttactttagatgaaatattatcagtaagtgagtttggataatgcttcacttaagattcagaacagttgtgtttcagtgtgtttgaacactttgtagtatatcacagctcttatttcagcaatgtagggaggatacgtttatgcctgtgttgaaggacttgtaaagaaaggactttgtgttgtaggaaaagtgttggtttgagatttaggcagcctgtattctatcccagttctcctcctaactagctgggtatctgtgggcaagtcactttacttcccaggaattagtagaagtggacatacagaagacaagaaataaaaagggccaagcacagtggcttgcacctgtaatcccagcaactcctgaggtcaggagtctgagaccagcctgagcaacatagcaagaccccgtctctacaaaacaaaatttaaaaattagccggtgtggtggtgtacaactatagtcccagctactcaggagactgaggcaggagtagcgcatgagcccaggaggtcaaggctgcagtgagctatgattgtaccactgcgttccagcctgggccacagagccaggccctgtctcaatcaataaatcattaagtttaaaaaataaattacctaattaatttttaaaatatataaataaataatttttttaaaaaaaggaagggaaggctgtaggctgggtaccagttccagttgaggttgtctctttagttgtactccaggtgccagattacaagttcacccgatgccaccccgtgtatttcagtggttgatgtttgataagaccggaggttaagatgggctctgactacagtgaacagtccagtttagcctgactgaagggtttatttaggtgatagggagaaatagatggctgaggagggaggttggccccaggggttaaggaccttgactgataagctaaggaatttgaattttgttctgtagtccctagggagtaattactgaaggttttgtaaactggactgacatgagccaggttacgactccaccactatctgcatggccttaggcaggtcaccaaactttcctagacctagaccttatagtcatcttttttaaagagagagagagagagtgatttggaccagatgattttgaatattgctctcctttcaaaagttctgagtctataacttgaagcatcattttattagttgaatgattagagacagatcctttaagaccttgctttatgatggattctttatcctatcagcgatctatctcagtcctatttgttgttgtaaactcaattacgtcaccgttcccagggagaggaaaacctactctgtgtgctttctcactttgcttcctagtaacacgttataataacggagtttttccttaaacaataaaagattttgttagaacgcaggttaagtgaactaaaaggcacacatacagtttatttcacggccaaatgccaaattttcctcaaattatttgcccactacctcagctagtctctgtctagttttgttgctgttgctggctgattaatatttatttatttatttatttatttatttattgatttttgagatggagtttcgctcttgtcgcccaggctgcagtacaatggcatgatctcagctcactgcaatctctgcctcccgggttcgagcagttctcctgcttcagcctcccgagtagctgggactacaggcacctgacaccacgcctggctaatttttgtatttttagtagatattggctttcgctatgttggccgggctggtctcgaactcctgacctcatgagggtgatccacccgcctcagcctcccaaagtgcttggattacaggcgtgagccgctacacctggcctttggctgattaattttaaaagcaattttagtttgatatttccatcactaattttttttttttttttttttgagacagagtctcactctgtcgcccaggttggagtgcagtggtgtgatctcagctcactgcaacctctgcctcctcggttcaagcgattctcctgcctcagccccccgagtagctgaaattacagacgtccgtcaccacactggctaatttttctacttttagtagtgacgaggtttcactatgttggccaggctggtcttgaactcctggcttcaagtgatccacccacctcagcctcccaaagtgctgggattacaggcatgagccaccatgcctggcccctaatttttcttaataaaaacttttaatacatgtctagagtcataatctaggtctccccccaccccaaaacagcccctgagatacgaatttgggggcagatagtttatttgggagatgagcctaggaagtttcagaagggagacagggaaatgagatagggaaaagaagaaaggcagtagagggtatattaatgagcagatgaccactgtgtgggaaactgaggctgtatagtgttgaggagtttggggaggctttatagaacattctctatagaacaacatatagagttgtctcatccagtggacgaggaagctggggacctatccactaactctcagccatcactggttgagggctgccctgggggtgggacactcccaggggtagtggggagagggagaatggcagtggcactgggacccatcaagcctacaggtgagtggcagtgggatgctatcaggccattgtgtgtctttcgcacctactgcccttgtgggagttgatgttgttttaaatctctaatgccttctttttctgatcaactgtttttcttgaaatatcaatttctgaggagcttctgagtcttcctgtgttctgttttgtacagaattctggggagaatttaattttagtttcttgtagtttgttctgctctgcagaagatgccaggaatgatctaaaatatgtacacttcgagatctgttaccagaggtattgatgccatagttgcctggctactgtattgaagatttttccttgagatatttctttattcaaaagtggttctatttttttaatgcgtgattgagcggccaacgaatatcgttctgagcaggtagaaaagttttagtggcgtatctctggattttgcacacgtagatttggcttctcctcacagcagctcaggagaatcactgtagagagaaaactctcctgtgatccctccctttaagaacagatggcgatcttggctctgccatcaagccaaaggaaacatcagtgataaccatcagaggacctgtatgagatgagaaaattcctatgaaaaatgacctagacgcttactcttagcagcacactagaataggtctcgtggtgatcttaggtgacatgcactaaatattattttaacaacaatgccacttttcttgaggttttaaagaatagttgctcagcaagtcagatgaaaggaagttctcaccagcagccagcccttgggggattattcatggatggcaggaatgtgcagaaaaggattcaggagacatgaaggaactatccatgtgctagttttcctgtgcagctgggggtgtgaggatggcccggtaagtggagcacatttatggaaaaatggctattacttgggtatttgggggaaggcttcttgggaggagctagaatctggaaagccatttggagtgacatatgaaacctggagaatagctcctgagtcctttggagtaggaagttccttgattaggcagagcctttgagaaacttggcataagaggaatagaaatgactccatgtggcctggcccgtccctcccggtttgctcctctctagctgccctcatccgccttcagtcttagggcagcaggctgttctcagctgtggatgttagcatatgctgtgcccccgcccagaatactcgttccctcattgcttacctgactgaagctgatgatccttcagggtctagtttcagtgtctctttctgagaaaagctgatgttgcaaagaataccaagtctggaaaggatgttcctattgttactcattctcatagcgcttgctatttccctttatagcactccatttctgtgtttacttgcttaatacctatcatccctcctgctgtactataagcctgagggggcaggggccatggtgtatactaggccgtgatatagccagtgcctagtaacattgtgccacccacagagtaggcactcagtaaagatttgttgaatggggttgggcgcagtggctcatgcctgtcatcccagcactttgggaggtcgaggcaggcagatcacttgaggtcaggagtttgagaccagcctggtctacatggtaaaaccccgtttctactaaaaatacaaaaatgagccaggcatggtggcacatacctgtaatcccagctactcagaaggctgaggcatgagaatcacttgaacccgggaggcggaagttgcagtgagctgagattgtgccactgcagtccagtctgggcgacagagcgagactccatctcaaaaaaaaaaaaaaaaaaaaaaaaaaaagccgggcatggtggctcatgcctgtcatcccagcactttgggaggtcgaggcaggtggatcacttgaggtcaggagtttgagaccagcctggccaacatggtgaaaccccgtctctactaaaaatataaaaaattacccaggtgtggtggtgcgcacctgtaatcccaggtactcgggaggctgaggcaggagaatcaactgaacccgggaagtggagattgcagtgagccgagattgtgtcactgcactccagcctgggcaacagagtcagagtccatctcaaaataataataataataataatgataataataataataataataaaataaaagccaggcatggtaatacatgcctgtagtcccagctacttgggaggctgaggcaggagaatcacttgaacccaggaggcagaggttgcagtgagtcgagatcgcaccactgtactccaatctgggcgacagagtgagactctgcctcaaaaaaaaaaaaaaaaattgttgaatgggtaagtgaatgaagaagtgactaatgatcaactgtggtatagtattagaagagagccacataatgagtgtctgggtgctacagttaatttaaagtttggtagtagaaagtaaacgtattgtattttctttatttatatgtgagtctgtgcttaaaaacaaaaacatccaagtcagacatactcattgtatacagaaaaatataaaaacataattaccgttgataccactacccaaagataaccattgaagtagggtgtggcccaaagcagggaatgcagaaaagtagaggagtccacatgggctaggtcagggtcagtggtgatggaagtcttcctagcgtgagaatccctggtgtctgctaaaaaagggatttgataaaaactcagaggggaacagatcttcctgaccgagggaacccctgccgcctcggtggtgttgacttgtgtattaggctagtgtaactgttgtaacagacagccccacaatttcagtgacttcacatgatggaagtttcttttcactcatgcactattccaatgtggatgtatcctggctgggcagtctcttcttcaggtgatttcttggtgaactcagtctccttacatcttgaggctctgccctctcctggatcctcagatctcctttcagccagatgataggaaaagagcatggtgacttgttagagaggttttgtatctgtgtttggaacagctttgctgagatgtaattctcataccatacaattaacccattttggctggatgcattggctcacacctgtaatcccagcactttgcggggccaaggcaggcggatggcttgagttcaggagttcgagactagcttgggcaacatggcaaaaccctgtctttacaaaaaaatacaaaaaaattaaccaggcattatggtgcatgcctatattcccagctactcgggatggcttgagccctggagtcggaggatgcagtgagatcgtgccactgcactccagcctggacgacggacccaaaccctgtctcaaagacccaaaaaacaacccatttaaagtgtacaagtcggtgggtttttttagcatattcggagttgtacaaccatcactacgatcagttttagaatgttttcatcatcctccccccgccaccaaaagcccatacccattaccacttaaccccacttcccagcttccctcaattcttccccccctattcctaagcaatcactgatccattttggcaacctgttaatgggtaccccctcttcttccgcctcactctctagcctgaggaaaacactagtctcttttctgtctctatggctttgcctgttctggccatttcatataaatggaatcatacaatatgtgttttgtgtgtgtctggcttccttagcatactgtcttcaaggttcatccatgtggtatcatgtgtcaggacttcattcctttttttggcttaatattccattgtacagataggccacactttattaattcatcagttgatgggcatttgagttgtttgcacttttgactgtactagagagggttgtaggagcctgctcaggaagtgatgttcattacttctttccatgtttcatcggccacaagtcagtctcgtgtcctaatctcacttcaagggaacttgggaaatgtggtctggctgagtgcccaggaaaaaaagaaatggggcttggtgatgctgctacaacttgcaaataaggagtagagtttaactggatctatcagcgtggagattcctggtgacatgtcacagagcaggacagagagttcaggcaaggccactcttcagctcctgctgcctttgtgtgaatgggaaagccagcctgggaaatgcccagccccatcagagggcctatcagcccactgtagaccctggccttcacaggtggtgctttgccatcccaggagactgggaaaggttgggatgatggcagctagggtggatgatttcatggtgattgtgcctgatacataactgggtcctatttgtagagtagaaaaacaactattcggatctgtacgtttatttgactctgaacattgttcacactaagacacaggtcgcttctagttgttcccttccatgtatgtaaatacgaggcatctggccagagcagggcacctgctttcttgtggtaggtgtgtatttgtcagggtccaatcgggaaacaaagaccactctaagtatttaaaatagaagaaacttaatgtaggaaattggttacacaggtgatagaagagctgacaaaccaatcggaaatgatgaggcagccctgaagttagcatcagcaggaagctgctgtcacccgcttggctggagggacccagggaagaggtgatgttaccagagcccaggtgccaggatcacctggaacaatcgtgagccagcctggtgggagctgggtctaacaaagagatgtggctattgctggagtggccatgcacaccaagaaaaagtgggagaagaaactgcgctggcttcttccatcccatcctccagggcctcaccctctgcccccagtgcctcccaccggttgctgtcagctgagcacagcagcctagaggagtcagctcccctgtaacacaaagcagggctgcagaaaggccaagaatgcatttgagggcagaccccagtgattgccccagtaggacactattcagaattactgctcagtttctagtatttttaaagtcagctttaataaggtgtaacttacataccataggccgggcactgtgactcatgcctgtaatcctagtactttggcaggccgaggtgggaggatcacttgaggccaggagtttgagaccagcctggacaacacagtgagactctgtctataaaataaaaatgaaaaaattatcttgccttggtggtgtacgcctatagtcccagctactcaggaggctgagatgggaggattgcttgaggctgggagttgaaggctgtggttgagctatgaccatgccacagtattccaacctgggtgacagtgagatcctgtctcaaaaaaccaccatacaataaactaaaattttaagtgcacgatttgatgagtttggccaaataaacacacccatgaaactaccaccacaatcaagatatagaatattatatccctgtgttaggccgttctcatattgctataaagaaataccagagactgggtgatttataaagaaaacaggtttaattggctcacagttctgcagactgtacaagcatggcattggtgtctgctcagcttctggggaggtctcaggcaggttttattcatggcagaaggtgaaggcggagcaggcagctcatatggtgagagggagagtgagggccggtggcacgacctctactcactgcaaccttcaccttctgggtttgagcaattctcctgcctcagactcccgactggctaggattacaggcacctaccaccacacctggctaatttttgtatttttgtagagacagggtttcaccatgttggccagactggtctcaaactcctgacctcaagtgatctgcccgtctcggcctcccaaagtgctgggattacaggcatgagccactgtgcccggactcagtgtgatttttacatttgttggggtttttattgtcactacaggagtgaagacctttcacattcttctacatcttaattggaagcagaagtctcttgtaaggtttttgacaggtgacccaacacaaagtttattctagaaaggacactggtctaatgagaccttttgtgtgttaaagctcagggctggcttagaaggaggatttattgggattctatttgtctcttgccctatgaatttcctcttacagacacacagtatagaaaagagggccagggagacaggatggttgatggcaagtcagtgctctggcacacccatagctcatggcaatgctttgaggtaagcaaagtcagacacttcaggtgaaggactgaggcacagaagggctaagtgccctcctcaaaattcaattgggtaataaatggtgtgaaaatagccaggatctagctctatatgattcccaatccagtgttgtgtttttattctgtgcattttttacataagtaatagatgtgttggctcatgcctgcagtctcagcactttgggaggccaaggcgagaggatcacttgagcctaggagtttgagatcagcctgggccacatagtgagaccccatctctaccaaataaataaataaaaataaaagctaggtgtggtcatgcgtgcctgtattcccagcactctgaggcaggagtttcacttgagcccaggagcttgagcctacagtgagccgtgatcacaccactcagtgcattccacttgggcaacagagcaagaccctgcctcaaaaaaacaaaagtgataatagatgaatatgtttgtatattactgtgaaaaactgaaaaacaatccatttaaagcagttatccctctaaactctaatctcttgtcccgtccatattccggaagtaacctgtcttgtcagtttggtgtaatatccttggagacaattttctatgtactttacatactgtgaaaatatgtcatactgcagagtttttaaactataggaccacacaggaggtatactgttgtttttttcacatagtaatcgatgcttagagatctctccatgtcactacaataactgctcagttagtcattcatttaacagacacttattgatcacctactttgtgccagatccagttctaagtacagtagttaacaaatcagacccaaaaagtctccaccctctcggagcttgcattctaaaatggggagatagaataaaaaaaacctaaatgtattaaaacagtttagggtgatagggtagccagtaagtaggatgggaagattgtaattttaagttgagtgctcagagaagaccacacctattagaaagtgacatggagcaaagatcagaaagaggcaagggaacataccatgtggtatgtgggggaagatcatttcaggtagagggatcagcatgtggaacagcaaggaagcttgtgtagctggagcatagtaggtgatcggggcacaggagtggtaagagatgaggttggagaaataactaggaccacatcttgtagatccttacaggccattggaagaaaattggtgtttgctctaagatgggagccactggtgagttttgagtcgaaggatgacatgacctgccttacagcgcagaggatcactatgacttctgtgttgagactagatagtagagaggtaagtgtggaagcaggaaatgacatggcttggaccagagtggtaagggtgggctttatgaggagtgggtcaatttcagatgtagtttgaaataaaagccagtggaatctcctggtccaataaatggtgttagaggaaccaaacatgactgcaaagtttttggcctgagtaagaggaagaatggattggccatttaacaagaagaggaagactgtagaagaacaggtttgatgggacaatcaagagtttgatttggggccagccatggtggtgcacacttgtaatcccagcacttgaggaggccaaggtgggcagatcacttgaggccaggagttcaagaccaccctggtcatcatggctaaacgctgtttctactaaaaatgcaaaaattagctgggcctggtggtgcacgcctgtaatcccagctacttgggaggctgaggcatgagagtcgcttcagcctgtgagttagaggttgcagtgagctgagaatgcatcacaccattccagcctggatgacagagttgagactctgtctgagggggacaaaaaaaagtttgatttgggacacgttaagtttgaggtatcaacatgcaaatgagttgctgagagggcagttggatatgtgagtctggattttaggggagaggcctaggctggagatagaaatttggaagtcatcaaaatatggatggtttgaaaagtcatggcaatggatgatcaagggatctagggtagttaccaagaaagatgaaatgtccaagggtactgccaagggacactccaatgtgaaaagatcagagagatggactaaagtaggagaaaatcgggcgagtgtggtgtcctgcaaatcagatgataaaagtagtccaaggaggaaggggtgcacggttgtcaaatgcacatgtatgtgaaataggacaaggagtgagaagggagtggtggattcagcaatgatgccaacccactgacgcagaaagtccagcatgagaagcactgatgtctgggtctccagagattcagatttaagctcctaggtgattgaattttttttttctttctttcttttttttttttttgacatggcgtttccctcttgttgcccagactggaggacaatggtgcgatctcggttcactgcaacctccgcctcctgggttcaagtgattctcctatctcagcctcccgagtagctgggactgcaggcacctgccaccatgccctgctaatttttgtatttttagtggagacagggtttcaccatgttggccaggctggtctcgaactcctgacctcaggtaatctgcccgccttggcctcccaaagtgctgggattacaggcgtgagccaccacgcccagcctcccaggtgattctaatatgcagccaagattcagacccactgtcaaagtttccttctcttaattgtgaaatggccttaattgccagaaacagatgttgctggctgattcaacataggagtttttatctgtaggcttgttcttggataccttgggatctggaaatgataagcagatccaaaagctgattattaaccactaaagggattagctatttaacacctgtcttaaagtggcttttaagctgaaaatctctttgcttttaattttttcaaatgtttgatttttgttttgtttatactcaaaagactttttgttttgagtaacaagggtaaatttcaagttaatgagaaaattcaagggaaatcttgatgtaactggtccaaaaaactaaaatccaaacaaacctgagctcatatcactaattaggcattagcttgggcaacatggtgaaaccccgtctctacaaaaactacacaaattagccaggtgtggtagtacgtgcctgtagtcacagctacttgggaggctggggtgggtggatcgcttgagcctgggaggttgaggctgtagtgaaccgagatcgtaccactgcactccagcctgggcgaccctgtctcaaagagaaaaaaaaaaaaaaagcattcaagtgagtttattgagtttagtacattcttttcagaatcatgaatatttcacacctcaaaagttggctaattacagatgtagaaatgttgtgcctcataaaagtttcaatctttttcatattcttgccacagacattagaaattatttaaatgctctagtaaatttgagttggtatctgttggctcttaaaaattaaagaatattatacaatggctgtgcaacaagagatccagtttgcaggttagttcaattagattctatatgacaaaaagaggaaagataaaatatgttagaacaggatcaaggtagaaaatggaaaaagtccgagtcaaaatacaggcttaattattacaggtttccagaaggtcgccaagtgtctagattagccctttccaacccaggttgggttccacaagagaattaagtcctaatgcccgctggcatctattgtatgaagtgattgaatttctcttctgcatccggaatgaggctggctacgtaccatccttgggagcactgaaaaaatagtcactcaaataatcaaataattttttccagggattaattctgtcatggaaccccggttgagaaagtctggccattttagatactaatttgacatctgggatgatgcagtagtttttgaggtgcatgtcctcaggaaagaaaacataaaagagcctattgtggccgggcgcagtggctcacgcctgtaatcccagcactttgggaggccgaggcgggtggatcacctgagatcatgagttcaagaccagcctggccaacatggttaaaccccatttctccttaaaaaaaaaaaaaaaaattaaaaaattagctgggtgtggtggtgcacacctgtaatcctagctacttgggaggctgaggtggaagaatcgcttgaacctgagaggcagagttgcagtgagctgagattgtgccaccacactccaggctgggtgacagagtgagactccatctcaaaaaaaaaacaaaaaaaacctattaccaagaaattaaaaagaataatttattcacttattagaatggttattaataaaatatacccaggaccaccttgtataaatcccagcaatgattttctgaacattttaatatgtatccttacagacttttgtctatgtacattaacatgtgaatgtgtttatttcaaagaatggggtcatgcttttcatttagttcaggttttttccatgagatgttactgttacggatgttcctctgggtaattacacgtggatctgtccctttataatgattacgttattctgtagtctggttgttgcaaaatatattttgctgttcttccgttaatggacatctgagtcatctccagttcattactattacaagcagtgccataacaaacatctttgttcaaaaaattcttgaaaaaagatgtacatattacagattctagaagtggaatcgttgggtcaggatgggtacctgttttgtttttgtttttgtttttatcatgtaaaatcacaaatatatttaaaagtagggaatagtgtaattatcttaggcagggttctccagaggaacaaaccaataggatgtatagagatctagaggaagagatggattatgagaattgcctcaggtgattctagaggctggcaagtcccatgcaagctggagaaccaggaatgcttgtggtgtgatttggtctgagtccaaaggcctgagaaccagggatgctgttggggtaagtcctgaagccagaaggtccaagatccaggaactctgatgtctaagggcaggagatgatgaatttcccagttcaaaaaaagaaaattcactcttccttggcctttttgttctcttggtaccctcaatggattgcgtgatgccacctgcattggtgagggtggtcttctttactcagactcttgattcagatgctaatcttatccagaaacaccctcatagacatacccagaaataacgttttactagctttctggtcttccttagcccagtcaagctgacacataaaattaaccatcacaataataaacccccatctaccccatatccactttgataattatcattgcatggccaattttgttcccctttgcccccacccactcttttataccccaatgctggatttattacaaagcaaagacataccattttatccccagatatttaagtgtgtatctttaaaagctaaggacacttggctgggcacggtgtctcacgcctgtaatcccagaactttgggaggccaaggcgggtggatcacctgaagtcaggagttcaagactagcctggccaacatggtgaaacctctattaacattacaaaaattagttgggcgtggtggtgcatgcctgtaatcccagctacgttggaaggctgaggcacaagaattgcttgaactcaggaggtggaggttgcaatgagttgagatcatgccactgcactccagcctgggcgacaaagcgagactgtctcaaaaaaaaaaaaaaggttaagggcacttacaaaacatagtcatgattacattatcatacctaaaaatgaacagtttttaggttttatattatcatacctaaaaattaacagtttttctgtcagtgctcaaattttcccaattgtctttccttttcttttctttcttttttttttttttgttgagacagagtctcactctgtcacccaggctggagtgcagtggcacaatctcggctcactgccacctctgcctcctgggttcaagtgattctcctgcctcagcctcccaagtagctgggactacaggtgcctgccaccacacctggctaatttttgtagaggcagggtttcaccatgttagccaggctggtctcgaattcctgaccttaagtgatccacccgccttggcctcccaaagtgctgggattacaggtgtgagccactgtacccagcctcatatgttttatagtggatttgtttgaatcacagtccagactatgtatgttgcatttagttgatatgactcttaagtcttttttattatataggtttcctcttcacttattttttcatttccttatgatttacttgttgagatagaatcaagtagggactgagtgtaattgtataaggtttactggtgtggatcttaagcagtggctacattggaaaatgaaaactattatttagaaataatttttctgttaaagtacagcatccttgcacctgtctttcagcatgatgaatgcgtatatgtatttcactgtctttttaaaaaaaaaaaaaaaaaaaaaagcagggtctcactctgtcgcccagactggagtacagtggcatgatcttggttcactgcaacctctgcctcccagtttcaagtgattctcctgcctcatactcccaagtagctgggattacaggcgtgggccactaccacccggctacttgtatttttagtagagacaggttttcaccatgttggccaggctggtgttgaactcctgacctcaaatgatctacccgcttcggcctcccaaagtgctgggattacaggtgggagccactgcacctggcctctactccattgtcttgattgattcatttgtgaccttataacatctatctttcaggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtaaaccctcagcccgagttatgagcacttgcatctcttcaaggaacagaatcgcataggctaaggatgtgcatctcttccttatgtatatgtctgtctgttggcagggagcaaacatttgtagtaaatgtggtctgggaattttcagattccctttttgagagaaaaccatgagaaacagggttttctactggtcacactcttcccacaggtacacttgtttatgggccaagaaggaggcccagcacactccttccgagctcccacttccagagccttgtccaccaccaccagggcatcatcttcccagtgatctgttcattcattcacttattcattcatttatttaacaatgttcagtgatggcttactgtgtgccagaaacttttctaggtggtggggatacagacacaacggacgtgaatcctgcccttgggggccttgcattgctggtgagggaagttaaagaaagtgacacattaggatgtcatctgagggctatggggaaaggttaagcagggaaggggataaaggagggctcggaggggtggtctgcaattttaaatagggtagtcagtgaaggtgcctaaagatagaaaagtgataagggagtgaacttcacagataactggagaaagtgttcttggtggaggaaacagcaagggcagagactctgaggatgaagcatggcaggcacactccaggatggtcagcactaagcaaggggtgagtggagagcaacatgaaacaggaagagggtaagaccttcttgctctgagtgagaaggaacatcaaatggagggtttgagcagaggagtgacaagattggacatgcattttaacaagagtactcactgttatgcaaagaatatattttagggagtgtatcagctatcacttgctgcgtaacaaccccaaaacttagcagcttcgaacagcaatgattatgatttttcatgattctgtggctttgccaggcacttcttctgctggcttcacctgggctggcttctaaaactgaagtcagctgtagggtcaggtgtggctggaagatccaaatgaccccgtacacatttggcagctggtgttggctactgatactgtaccttagctctccaccatgtggttctaatcctggtagaccagctttcttacctggtatgcagaactctaagagagtgaacaagggagcagcaaagcctctagaggcttaggttcgggaactcacacgtggttacttctgccacatgctattggtcaaagcaaatcacaaggtccgcccacattcaaaagggtggaggaatgtgctccacctctggctaggaggaatagcaaagttgcattgcaaaggtgcatgcatattgcgatgggaggaatttgtggccattaaacagtctatcacagggacaaggacagaagcagggaacaggagaatatagcagtaattcaggggagagctggtggtggcttgagccagggtggtggggacaaaaatgttgagaaagttggatgcaggatatattccgaaggtggaaccaacaggcccacatcattcatttccatcataagagctcttgacattgctgttctgctttcattcaattctaactgcttcctctctctctctctctctctctctctctctctctctctctctctctctctctctctctctcttcctttcatacacacaggaggctctgtcctccccaccttctctccatccacacttacttctctgacaatcccagccactctcacacctagggacccttagctggagctctccaacccaacatcctaagtgatggccttacacctccccccctttgtccacctgttctacctcaagatgatgttgatatttcagactcaacattttgaaggctgaagtcatttactcttctccacaaggtatggcttccaatgtcttactttcttactactattctctaccctcctaggtctaaactttcagtcagtgttggattcattttgctcacttacctccccgtccagtcaggccccatttgcagcccttctgcgagccttctttcactgcttgccagtcctttcccatcaccactgcccccagtcactgccattttctttttaactttcttgccaggaatgttctaacagtacccaagtagactccctgcttgctgtctgctcagtctatccttcacagatttatagcttattcttcctaaagctcaagaacccaccatggctccctgctccctgctatataaaaattcagactctcagatcaccattctaggtgtcctgaacactttctccaacctacctctagccttgtttcccactacctggtgtgtgtccaactaaactgtagttcctaaggagttttccaaactcctgtctctgttcctgttttctatgctgagggctccctttccaaatcactgctgtttcatttctcttgccctttttttttctttttttgagactgagtctcactctgtcacccaggctggagtgcagtggtgtgatctcggctcactgcaacctccacctccctggttcaagcaattcccctgcctcagcctcctgaatagctgggattacaggcacatgccaccatgcccggctaatttttttgtatttttaatagagatggggtttcaccatgttggccagactggtctcaaactcctgacctcaggcaatccacctacctcggcctctcgaagtgctggtattacaggcgtgagccaccacacccggcctcatttctctttatttttatgccatatctcaagtatctaggtgagatagccctatatgtcttctgtgagttcctccagacttgaatttgtgtgattttaagataccatattcttgcttacattgtcactaattatgtgtagatcttattcccttccaccatagtgtaagtccttggaacataatgacctcattttctttttttaaatttccagtagttcctaatgcaccatgtggtggagaggagtcactcagggtatcgaagggaagttaatgtttggtaaagccaaaacagaaaactgtgttcccactatggtggtggggaattcagtccccaggtcagaaaatcactgcctttggttccttcaagaaagtcctaggagtttttctccagcggcttcagaaggtggtggcggtaggtgcagaagcaaatgaagcttcgtcttctgctcagggcgtggtggctgtggataagatctatcttggatatcatctaacccacactctccagtgcagacacggagcatatggctcagggaggtagggagctggtccaagaccacagggctggttagtggtgaatctggaactatggtcctgcctggagttcagatcttctctgcccctaagttgggcctgcttgacttctggaggagcaaccctttctgccctcttctcagtatgacttttcatagtagaagaaaataaaacagtcacatctagaaggatgtagaatttaaaattcccaaaacacacaggaaaaaaagggttgaattttgttgactaaggtaggaaggactttctcggtgtcctctgatctgagggtatttgtattatgcctcagaattgataatgccatattttaactgacttcaatgataacttctcctttcaagaattaatattttgttgttgaattctcttgccatcacataagtgacaaaattactactagcaagtctttggtataaatggtgccacttaaagacatttgtgtcattacttcattgagttctttttttcctgcctataattttcatactcgttcatagaacagaaatgaacttttcatgtatagaaaaagatgagagtgaaaatgtcactgttaacctttggtgtaaaaataggattcccaattttgtatcctgttgcttatcctgatatagtagatccctgtccctggcctcactttgccactgctcctatagttatttgggatccaggattttggcaatacggcttcctgcatgaaaaaacaactccatattgttaaaagcaaacaaacagcttgcagagaaatggcctaccattgatgccatttcgatgtaataaaaaatactcaatgcataattggaatccaactttagaaacaaggtttaggtgggcagggtggctcatgtctgtaatcccagctacttgggaggctgaggtgggaggatcgcttgagcccaggggttcaaggctgcagctatgattgtgccattgcactccagcctgggtgacagagtgagaccctgtgttttaaaaaatgaaaaaaaaaatgcataggtgtgtgcatgatggcacaaacctgtggtcctagctgcttgggaggctgaggtggaaggattgcttagatgcaggagtttcaggctgcagtgaactatgattacaccactgtactccagacatcaaatcgtggtgatcttttgggagtaggattagaattgattttaaatttcttttgtgtacttcatgatgatttccctattttatatagtccctgaggcttttataataaaaatcctatgagcaaaaaaaaattaaaactccctagtgtaagttactgtgttgctattatgactttttttttttttttttttttttttggagacagattctcgctctgtcacccaggctggagtgcagtggcacgatcttggctcactgcaggttccacctcccgggttcaagctaattctcctgcctcagcctcccgagtagctgggattacaggcacacaccaccacacccagctaatttttgtagtttttttgcagagatggggtttcaccgttttggccaggctggccttaaactcctggcctcaagtggtccacgtgcctcggcctcccaaagtgctgggattacaggcatgagccacggtgcctggcctattaagacatttttaaagttactagagagctgcatgtggctgttggtaaaggtggtggtgggaggcgaggggaatgggcaacaacaaatttagagaaagaaaacttttcatgagaaagttggtttataccattatttaaacattttttgttgtaatataataatactttggtggttctgtaattataggtatcgcaaagggtttgaactccagtcatccctctattcgggaattaatcttgcagttttgctgattgttgctggacaacaatttgaaacttccttggaactaaggaaaataggtaaagctgcttattattgcagatgttgttgctttgattatacaagtttggcattaaaagttatgttgaaataactagcattatatcattatatttctattctttttttgagacagagtcttgctcggttgcccaggctggagtgtagtggtgtgatcttggctcactgcaacctccgcctcccgagttcaagcaattctcctgcctcagcctcctgagtagctgggattacaggtgcccaccaccacgcccagctaattttttttgtatttttagtagagatggggtttcaccatggtggacaggctggtctcgaactcttgacctcaagtgatccgcctacctcagcctcccaaagtgctgggattacaggcgtgagccaccgtgcccgtactactagaattatatttcaaaaggaacaatcagttacttttcctatagcacacctgagacagcagccaaaataaaatacctgcttatcctcagtatgacagaaactaaaaaagattattctgactatcaaaaattcaaattcttaaggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtgagttgtgtctgtgtgttgtcatcacccatctcaatacatgatcttgttctgaaatgtcttccttataatcactatgtttctccttctgacttttcattaaagcaaagttagcacagacacaactgctctgagaattcccttgcttttatgtgaagggagggaaagacagatccacacagaatatatccctgcctgctccacccctgagattaggccttctattctattaatttctgcaggttgtctaggtcctcaagagaaaaacactcttggctactagtatgtattatgcatttgtgagaaagcatataataaaatgaaaaaagcacaccaagaaaatgtttatcacaaatgaaaactggaactaaaagaacaataatagggtatggtaaataaaacggtggcacagcaacagccttacacggccatttaaatgtgcaggaaagaatgtttggagatgtggaagtgtgttcgtggtttgttgtagagtaagaaaagccagtccccgggtaagtttttctgtatcagtggttctcaaattctgttgtgtgtcagaatcaacctatgttgattaaaacacagactgggtgtagtgacttatacctgtaatcctggcactctcggaggccgaggtgggaggattgcttgagcccagtagcttgagaccagactgggtaatagagtgagacccagtgtctacaaaaaaaaaaaaaaatagccaggcatggtggtgcacgcctgtggtcccagctactcgggaaggcagaggtagaaggatcgcttgagcctgggaggtcaaggctgcagcgagctgtgattgcacaactgcaatccagcctgggtgacagagtgagaccctgtctcaaaaataaataggtaaaataaagaaagaaaacacagattgctgggcccactctcagaatttctggcccagtaggtctggggtggacgcctgagaatttgcacttacaaattacaagctgctgctgctgctctggtgaccacactttgagaaccactgttctatatgatcttgttttaattaaaaatatgtgtttggcatgtgacttgtagggaaaggcccaggaggggtggacagtattggatttccccatagacatgaagctccgttagaattgtggtaacaaacctgcatgttgcacacatttaccctagaacttaaagcataaaaaaatatatatatatatgtatatatatgtgtgtatatatatgtgtatatatatgtgtgtatatatgtgtgtatatatatgtgtatatatatgtatatatatgtgtgtacatatatgtgtgtatatatgtgtgtgtgtgtgtgtatatatacatgatttgctggaaggactcacagaactcagaaaagctgttacactcttagttatggtttattacaatgaaaggatacagattaaaatcagcaaaggcagaaaggtacatagggtagagtccaggagagaccacgtgcaagcttccagttgtcctttcccagtggagtcatgtgaatagtgcttaattctcccagcaaaaatgtgtgacaacatgcatgaaatcttgccaaccagtaaagctcattgagccttaatgtccagggtttttattggggatgggtcatgtgggcatggagtcttcatgcagctgatattaatacctcagctccaacctctctagaggtcgaactgatacagtgtggcccagggccccgaagatgaatcatatcgttagcatagactatctgggatggcccaaggtcccagataaacagagatgctcttagctggcagtatatcccaagggcttagaggtgatctcccaatagccagtccagggccagatctttcttttgaatgtgtggagttgggacaacacaggcctgctgagtgcccaagcaagtcggttggagtctagctggcctatcttcccaggatagctccagcttttatccttaaagagcaaaataatactatgatgctttcagttgaaccattccgtttagtaccaaagaggttgtgaccaccactgcctggcaactatattccaaaaagttcagtttgcctgaaaagagcaaaggtgtggtcagagtcaagatgtcataacatcaaaatctacctagtcagattctaatatttcaaaaaataaaagacagtgagtttgactagtgattgccagaagtaagggagggggtgggatgggagggaggtaggcgtgatggtgggaaggcaacacaaggggtccctgtggggatggaaatttctctaacttgccttgtatcagtgacaacatcccggttgtgatacagtactatagttctttttttttcttttttttctttttttcttattatactttaagttttagggtacatgtgcacaacgtgcaggttacttacatatctatacatgtgccatgttggtgtgctgcacccattaactcatcatttaacattagatatatctcctaatgctaaccctcccccgcccccaccccataacaggccccggtgtgtggtgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcgtccttttttatggctgtatagtattccatggtgtatatgtgccacattttcttaattcagtctatcgttgttggacatttggcttggttccaagtgtttgctattgtgaatagtgccactataaacatacctgtgcatgagtctttatagcagcatgatttataatcctttgggtatatacccagtaatgggatggctgggtcaaatggtattactagttctagatgtctgaggaattgccacactgacttctacaatggttgaattagtttacagtcccaccaacagtgtaaaagtgttcctatttctccacatcctctccagcacctgttgtttcctgactttttaatgatcgccattctaactggtgtgagatggtatctcattgtagttttggtttgcatttttctgatggccagtgatgatcattttttcatgtgtcttttggctgcataaatgtctttttttgagaagtgtctgttcatattctttgcccactttttgatgggattgtttgtttttttcttgtaaatttgttggagtttattgtagattctggatattagccatttgtcagatgagtagattgcaaaaattttctcccattctgtaggttgcatgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgcataaggtgtaaggaagggatccagtttcagctttctccatatggctagccagttttcccagcaccatttattaaatagggactcctttccccattgcttgtttttgtcaggtttgtcacagatcagatagttgtagctatgcggcattatttctgagggctctgttctgttccattggtctatatctctgttttggtaccagtagcatgctgttttggttaccgtagccttgtagtatagtttgaagtcaggtagtgtgatgcctccagctttgttcttttggcttaggattgtcttggcaatgcaggctcttttttggttccatatgaactttaaagtagttttttccaattccatgaagaaagtcattggtagcttgatggggatggcattgaatctataaattaccttgggcagtatggccattttcacgatattgattcttcctacccaggagcatggaaagttcttccgtttccttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttagtggtgtataagaatgcttgtgatttttgcacattgattttgtatcctgagactttgctgaagttgcttatcagcttgagattttgggcgagacgatggggttttctagatatccaatcatgtcatctgcaaacagggacaatttgacttcctcttttcctaattgaataccctttatttccttctcctgcctgattaccctggccagaacttccaacactatgttgaataggagcggtgagagagggcatccctgtcttgtgccagttttcaaagggaatgcttccagtttttgcccattcagtatgatattggctgtgggtttgtcatagatacctcttattattttgagatacgtcccatcaatacctaatgtattgagagtttttagcatgaagcgttgttgaattttgtcaaaggccttttctgcatctattgagataatcatgtggtttttctctttggttctgtttatatgctggattacatttattgatttgcatgtgttgaaccagccttgcatcccagggatgaagcccacttgatcatggtggataagcttttgatatgctgctggattccgtttgccagtactttattgaggatttttgcattgatgttcatcaaggatattggtctaaaattctcttttttggttgtgtctctgccaggctttggtatcaggatgatgctggcctcataaaatgagttagggaggattccctctttttctattgattggaatagtttcagaaggaatggtaccagctcctcattgtacctctggtagaattcggctgtgaattcatctggtcctggactttttttggttggtaagctattattgcctcaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgcatctgtttgattcttctctcttttctttattagtcttgctagcagtctatcaattttgttgatcttttcaaaaaaccagctcctggattcattgatttttttgaagggttttttgtgtctctatttccttcagttctgctctgatcttagttatttcttgccttctgctagcttttgaatgtgtttgctcttgcttctctagttcttgtaattgtgatgttagggtgtcaattttggatcttcctgctttctcttgtgggcatttagtgctataaatttccctctacacactactttgaatgtgtcccagagattctggtatgttgtgtcttttttctcattggtttcaaagaacatctttatttctgccttcatttcgttatgtacccagtagtcattcaggagtaggttgttcagtttccatgtagttgagcggttttgagtgagtttcttaatcatgagtactagtttgattgcactgtggtctgagagagagtttgttataatttctgttctttcacatttgctaaggagtgctttacttccaactatgtggtcaattttgaaataagtgcagtgtggtgctgagaagaatgtatattctgttgatttggggtggagagttctgtagatgtctattaggtctgcttggtgcagagctgagttcaattcctggatatccttgttaactttctgtctcgtggatctgtctaatgttgacagtggggtgttaaagtctcccattattattgtgtgggagtctaagtctctttgtaggtctctaaggacttgctttatgaatgtgggtgttcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccgtttattttgagcctatgtgtgtctctgcacgtgagatgggtttcctgaatacagcacactgatgggtcttgactctttatccaatttgccagtctgtgtcttttaattggggcatttagcccatttatatttaaggttaaaattgttatgtgtgaatttgattctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgagaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgcagagagatcagctgttagtctgatgggcttccctttgtgggtaacctgacctctctctctggcttcccttaacattttttccttcatttcaactttggtgaatctgacaattatgtgtcttggagttgctcttctcgaggagtatctttgtggtgttctctgtatttcctgaatttgaatgttggcctgccttgctagtttggggaagttctcctagatactgtcctgcagagtgttttccagcttggttccattctctctgtcactttcaggtacaccaatcagatgtagatttggtcttttcacatagtcccatatttcttggtggctttgttcgtttatttttattctttttttctctaaacttctcacttcatttcattcatttgatcttccatcactgataccctttcttccagttgatcgaatcggctaccgaggcttgtgcattcatcacatagttcttgtgccttggttttcagctccatcaggtcctttaaggacttctctgcattggttattctagttagccgtttgtctaattttttttcaaggtttttaacttctttgccatgggttcgaacttcctcctttagctcggagtagtttgattgtctgaagtcttcttctcttaactcgtcaaagtcattctccgtccagctttgttccattgctggtgaggagctgcgttcctttggaggaggagaggtgctctgatttttagagtttccagtttttctgctctgtttcttccccatctttgtggttttatctacctttggtctttgatgaaggtgacgtacagatggggttttggtgtggatgtcctttctgtttgttagttttccttctaacactcaggaccctcagctgcaggtctgttggagtttgctggaggtccactccagaccctgtttgcctgggtatcagcagcagaggctgcagaacagcggatattggtgaacagcagatgttgttgcctgatcattcctctggaagttttgtctcagaggagtacccagccgtgtgaggtgtcagtctgcccctactggggggtgcctcccagttaggctacttgggggtcagggacccacttgaggaggcagtctgtccattctcagatctcgagctgcgtgctgggagaaccactactctcttcaaagctgtcagaccgggacatttaagtctgcagaggattctgatgccttttgtctggctgtgccctgcccccagaggtggagtctagagaggcaggcaggcctccttgagctgaggtgggctccacccagttcgagcttcccggaggctttgtttacctactcaagcctcggcagtggtgggcgcccctcccccagcctcactgccgccttgcagtttgatctcagactgctgtgctagcaatgagtgaggctctgggcgtaggaccctctgagccaggcgcgggatataatctcctggtgtgccatttgctaagaccattggaaaagcgcagtattagggtgggagcgacccgattttccaggtgccgtctgtcaccccttgctttgactaggaaagggaattccctgaccccttgtgcttcccgggtgaggcagtgcctcgccctgctttagctcacgcttggtgcgctgcaccccctgtcctgcacccactttccaacactccccagtgagatgtacctggtacctcagttggaaatgcagaaatcacccgtcttctgcatcgctcatgctgggggctgtcgactggagttgttcgtattcagccatcttggctctaccaaaaactgtactatagttttgtaagatgctaccattggagtaaacctggtcaaagatatatgggttctctctgtattggttcttagcacttcatgtaaatctaaaattacctcaaaataacatgtttaattaaaaagaaaatgagtttgaaattttgtcattttgtaattgctttgaactttgaactacagctgacccttgaacaatgtgggagttaggggctcagttgaaaattcaccaaaaacttaactacgaatagcctactgttgactggaagccttaccaataacataaacaatattttgtattttatattttgcaaaaagtgcaggattttcgcaaccactgacaactgcagtgacggcttcatgaatttccttttctgtttctcctacgatttttaggctggcttcatttatcttgaaatggcagcagccgtaactgcagaactcaatctgcaatacatatcaagcaattcaactttttctggtaatgtcatgacttttctcggcttcttgggagcatttccagtatcactagtggcactctctatgggtcccatggtgttattcattgtttatggtgtcacactaaatacaatgaagaatgcacgagaaccgtgagtgatcactttttactatgatctgcaatttactggagagacgaacttctcatgcaaaaatgatcagtctcacacggtggaagttttttttttttggttgtttgtttttgagacagagtctcgctctgttgcccaggctggagtgcagtggcacaatctcagctcactgcaacctccgtctctcagcttcaagcattccttctgcctcagcctcccaagtagttgggactatagacgcctgccaccgcatcctgctaatttttgtatttttagtagagacaggatttcaccatgttggccaggctggtcttggactcctgacctcaggtcatctgcccacctaggcctcccaaagtgctgggattacaggtgtgagccaccgcacctggccacatggtggagttttaagcagatacttacaacaggagctcaccacaatagcaacaggaggtggctatgaaattcttacagtagtgcagtatgcactacagttaattttatgcagttttgatataataccacatctttacatttgtttatatttttcttgactgggaatggtgccatatacagtctgtaagtgtgtgtgtaagttttggtacattttaactttttgtaagagatttgtatatatgttgggtagtaaatgataaaatggaccagtacctacatatattttatgtgttcatggcatacctagctttttctaatttttttttttatatttctaggcttcacagtttatctgcaaagtttttcaaattgtcgcacgtctccagaacattttccaatgtatctattgggaaaaaaaatccatgtataagtggagctgcgcagttcatacctgtgttgttcaagagtcagctgtgcctgcccttgttatttaaaacagttaccacatgctttccaatctccacattttaggcagtaggtactaaaattggggttagcacaatgttggtaaaaagccacgttgtgttattttgttggatggacttactttgcctactgctcgtgttttcttaattagttttgtggctgctgagcagtcgtttatgaagcactcatgacataatatgaatttaagtgaataaaagcttttggaaagcttcttttaaagggacttgaattgaattcagtttctttaggaatccaatatattgctgtttgtgatttttccaggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccagtaagatatgctaaatccatttttttttaagattaggaaaaaaactagggattggtgctatttaactattgaatactctgaactgaagaaaactgtagagtaattttaaatgttgggataaacatcaatcttatgtgaaatcagtaagtgatagatcagctcactcatagatcattggccatatcctctatagtagtcattctcaattggaagcaactttgtccccctaaggtacatctggtaatgtccggagacatttttggtggtcatgacttggggagaaggtggcactactggcatctgctggatagagaccagggatgctgttgaacatcccacaatgcacaggacagccccctccaataaagaattatccagcccaaaatgtcactagtgccaaagtggacaaactttcctctaaaacaatgtagcaccacgagtggaaacttggaattcagcgtggtttcctgttaagctttggtttgcctctaaggccactaattgatatttaaaagttaccaaaaaggcaaaattgcttttagcttttccttgagtttttgttttaatgttatgaccgtcttagagtcatgagtgaaatatgtgaatgtcttggaaattgaacttcagataattgtgttccatatttatgcgttgagaatttgtgaacatgccatttccaagaatttcattaagcatctaataaaatattgtttgaaatgattatgataattattttgttgccggttaataatacattttaaaatctttttttagttatgaaatatttcaaacctactgaaaggtacaaaaaaataatggagcagacaaccgcgtaatctctaaccaggtttagtgatcttaaacatgttgttttatttgttttggagatttattccctctctccctcctcatctcacccctcctctttctcttcccctcctcttttttttttttttttctttttttgagacggagtctcgtgcagtggtgcaacctcggctcactgcaacctccgcctcctgggttcaagtgattctcctgcctcagcctcctgagtagctgggattacaggtgtataccaccacacccatctaatttttgtatttttagtagagacagggcttcaccacgttggccaggctggtctcgaactcctgacctcaagtgatccgcctgctttggcctcccaaagtgccctcctccttctctcccgattttcttcctttggcctccttcttctctccttttccccttttctctttttcgtccccttctgttctttctccccaccttttctctccccactctcctcctcctcaccctcttctccctctctcccctcccctcctctcttttaacaaagtaacaccttactgatgggctatcacctctttttttatctcctttcatcttccccacccccccccccaagagatggcatctcaatatgttgtccttgaactcctgggctcaagtgatcctccgacctcaacctcccaaagtgctgggattacaggcgtgagccactgtgcctggccctcagtgaggatatattgagtacggacctccccgcctcctcgctgggcagggtgcgctatgttttctacccatgtacgttaacaggcatctgttcttgtttcaggttctggtcatagagccaaccaaagtgtaccagccttcttatgtttccataaacaatgaagccgaggagagaacagtttctttatggcatgtctcacccacagaaatggtaaggaggaaaaatcacaagcaatttaatcagttttcaaataggagagtctagatggtagtatttgaaggaaaaggcacccatgtttaacttctgaattatgagaatatatgagagagtatcatcacagatgagagacagtaggtttttccattttgtgtgtgtgtgggcatgtgtgtgtgtgggcatgtggtgaggtgtgggggtgggggagtgtgtgtgtgtgtgtgtgtgtgtgtgtgtataaaaacattaaaacaaatacaggttggtttgtttttttatagttaaaccttagggaagtgggtagaggatacaggctggtgtgttgtttcacagctgtagtcccaacacttttggaggccaaggcaggcgggttgcttgagcccaggagttcaagaccagcctgggtgacacatcaaaaccccgtctctataaaaaataaatttaaaaaattagccgggtgtggtggtgcacacctgtagtcccaactacttgggaggctgaagtgggaggatcgcttgaacctgggaggtcgaggccacagtgagctatcattgcaccactgcactcgagcctgggcaacagtgagaccctgtctctagaaaaataaaatagtaatatatttttagaagcacttatactggctttcttgatattcctcaactattactggatcctgtggctttccagataaaactcagactcttttactaagtgttcaagtccctccctatataatcctgccccctcccttcctctttctcttcagccctcagtgccagtcaggctgtcctcttactcgcccctgagctgtccctgcgggagctcctgtctaccctttcatttccatccttgttccttttgggatttccttcttccgattatccaagtcctagcttttgcaaagtcatctttaaccactccttcattccttccgctgagtgtctgtaggctaccaattgcctgtatcatgcacagaagaacatcctaagaatgcccatacatgacttgtatgtttgtagctgtaggagctatggaacagttacccactcctgaacaaatgcctgttgattattacataaaatgtgttgtttacttaactagtaaatgttcctcccaaatcaagaagttctctaaagccaccgtggaatagacctgccattggggaagtctttggaaactcatgtggctaagctttctgtatatgtgcagcctcctgcaggtggctgtgggttagacaagactcttgagtctgccctggctcccatttctgtgcctgaatccaaaggccgactcctgctgtctgccactatcctctctgcatgactttggactcatgtctcctctgaagtacacttagcctttctatgcagttggatgtgatttgctggctttcatattctcctaccctcttatgagaagcctccagtggcttcctgtctcacgcagagtcaaagctgacatcccgagggtggcctagaagtcctgcatgatttgcccatgagctctccaacctcctcttctactcccatcccgctcactccactgtagccatatttgcctctttgttggtccccgaacgtgccaggcacacccctcctcagggcctttgcacttgctgttccctctgcctggaactcttcccccaggcatccacgtggcttccttcttcccccactttagctttctgttcagaagtcatcagcgacgcctaccctgaacatcctgttgaacaacgtgaccccctgccctatcttaatgcccttccctactttatttgtcttcataacacttttcaccgccccccatggtatgattttactatttaatctattgtccatctctcttcactcacatgcaaggcccatgagggcaggaactttgtggttctctgctgtgtcttcagtattagtactttgcctagcacatacatagtaggtgcttgatcaacacgtatgactaaaacttctcccatcggaaaccatcttcccagtctgttcctgttgtcattgctccaggatggcaagaaactagtcatgtgcctattcatggcagttctcttgagccaaatgctcagtcacatggttctcatacttttcttccctgggtggcttagttggtcacttgtgacattcctcaggccaaccaaatggaatttttttttttttttgaggcagggtctcattctgtcacctaggctggagtgcagtggagtgattttggctcactggaacctctgcctcccaggttcaactgattgtcccatctcagcctcctgagttgctgggactacaggcgtgtgctaccatgctcagctcatttttgtatttttagtagagacggggtttcagcatgttggccaggctgatctcgaactcctgacctcaagtgatcgcccccacacctcggcctcccagagcgctgggattacaggtgtaagccaccacgcctggcccaaatggattttcctacttaaaattattttctgcaattgtgatgtattgatgttattgcctatggattttccaaaactggagtttcagatgttccttctcaggcttagctttgtgcaaagtgtagtggtagtgaagggaggggaccgagttagtttttgtttgtaagtgcaacttgggtgctgtttgaaatcccagttagtttttttattagtcatggtaggctagcttctaaaacaaacagcccccaaatctcaatatcttaacatgataaaagtttatctatgcctcatgtcatatccaggttgcagagggtggcggtggggggcattccatcttgcagtggatggggaaagaggaaatagagggttgctgtggagtttttgagtcaggcctgcaggtgatgcacagcattcctgctcacatcccattggccaaaactccactgtatatctctctagctgcaagggaggctgggaattgtagttcagctctatgttcagggagaaaaggaagactgatgaatgctgaaaggtgtctgtcgcagtcttgcctctcccaacatttttgcaagtcactcaacttaggtgggctagtcccatgcttgttttagagtttgcctactatgttgacagaagatgaaaagccactcactgtgtgtttattctatgcttattatttctatctgaaacttagattatttcaaatttacatcatttaaactggattagagatacaaatgaatttttataatacataagaaaatgtttctggtgttccatgttatacaaggtgtattgctgtaacccgtaaaaaaatcaccactgcaggtaaaatagcagaaatgattgaccatagaatgaaacaaaaaaaatcatttgctttaaaaaactcaaactattgacttctgtctttgataacttgcagaaacagatgcacgaatggaattttacagcctcttccataaagggaataaggtaagaacataggagaaaatggagttactattttaatgcaaatgatgataatgttttatgcactttaatgtttccacttactcataatatggaatgttcttatttttaatggaatccaaagtggactctctattatgttgtccttcctgagctagttattaatactagtgtactcctagtgagaacttcttgggttattataatagagtagctttgctcatattcagcagactaaactcacttgtgccattttttttaaagaagtgatcggtaggaagagaagatgtatcttttttgagccaaagatgttcaagtgctcagtgactctgagaactgaagccaggagatgattagtggcaacactcgggttggggtcttgtgaacagagtaatggagctgggagatttttttcagggagggcatgaggtggtgtattctcgggagaggagtagctcttgcattttggttcaggagtgatgacagtttgagcctgagctgtgtggccttacccaagcagggctaaacatctcagctgcacttgtcaccctggcagctcattcgagggtgagactggctgtgaagtagatgtgagttctaatctctctttgctgggtgatgttaggaaagtcactcagcttctctaagtctcagtttcttccctattttcttcaaataaagggcttgtactagaacattcctttctctgactctgaggctacctcagccactgaatgaatccccagttacttctagacatagtgtgatcctgtcctggaaacatcagtattgaaattaggataccatcaacatcacttaaaaggagggaaataatttaagtacaaagtagtgcattgggatgatactgcccaggaaatacaaggcaatttgaaatacactcagcaaagcatacacaaagcagcagaaaagggaataaaatatggtctctgtcctcaaggagtttatagtctcatgaaaaggaaaggtaaggtatttgagaaataatttattgtggtattacaagaatttctagactcggaaaatatcaggacacagtatttgtggccacacgagggaaatggaaataaacacggcactgtagctcaagaaaggcctttctttaaatgttatctggtccatctccacccagtgtgtgtacctgactctacagctcatccagcaagcaatattcagcttgcctgagcatagctagtgacagaaaatctgctagtaaaatatgtatttttattttttaaattattttattttattttatttttttgtcttgctctgtcacccaggctggagtacagtggcacgatctcggctcactgcaacctctgcctcccaggttcaagcgattctcctgcctcagcctccagagtagctgggactacaggtgtgtggcacaatgcctggctgatttttgtattttttgtagagtcagggttttgccatgttggtcaggctggtctcgaactcctgacctcaagtgatccgcccgcgtcagcctcccaaaatgctaggattacaggcatgagccactgtgccttgtgaagattttcaaaaatgtgttacttagtaattaagttgtgttagagcaggtagtcaagatccttctgtttgtgcctcctcatagagatacctctaggtgccatttcagccatcagtggggatttacaaagggcctgagggcgtatcatcctcgccccacccctccccgggacccatgtgacctgaagagtatactttgagcgttccagaggctctccaactaactgtggtggttgctttacagattgattttcaaaacctgctcacttataatctagttctaattctttttgaatctcctctgtactcttggtgttccaacccagtgtttgtcatgcaatctataacataaagaatggtctaggacagtttggatctcagcaagagataacttagaaaggatgagataaagtggcttcagttgtttgaagggacaatgatagaagagaatctagccttcctctccataatacctcctggcatgagggccactgctctctgacatacaatctactagcagatttcctgtcactggctatgtccaggcaagctgaatattgcttgttggatgagctgtagaatcaggtacagaccctgggtggagatggaccagataacaaacatttaaaggcctttcttgagctacagtgccatgtttatttccatttcccttgtgtggccacaaatactgtgtcctgatactttccgaatctagaaattcccttaataccacaataaattatttcacaaataccttgcctttctttttcatgagattataagccccttgaggacagagaaccatattttattcccctttctgttgcccgtatgctttgcttagcactgaattatattaagagtaagttcatattaaggtcagttgataaatacaaactcaaatataagcaagataaatgtctctggtatttaaatttcatagagaaataaaaggcagactcggggggtgtttgtttaaaacattaatgaatctttcaggaattgataaaatagaagaaaagattgtcttgcagatttagagtgggtatcataacttatgtataaacattatgctttgaaattttacagcctatcaaagtttgatgaaaggtgttgttttctttatgtccatgataattctgatgactttcaaatctacttttccaccgaagagcagtgcagtaggtgagttacagccaattcaggtatttgcaatgtaattatggcgaatcatttttaaagggcctttgttctgaaagatatttacttgctattactgtctttcttgaaatgttaacttacatctcaaaaaagctctaaaatttctgtaattcacatagcaggtaattcagccatttaaaatacacaacttggccaggtgcagtagctcacgcctgtaatctcagcactttgggaggctgaggagggtggatcacctgaggttaggagtttgagaccagcctgaccaacatggagaaaccctgcctctactaaaaatacaaaattagccgggtgtggtggcgcatgcctgtaatcccagctacttgagaggctgaggcaggagaatcacttgaacccgggaagtggaggttgcagtgagctgagattgtgccattgcaccccagcctggggaacaagagcgaaactccacttcaaaaaaataaataacataacattcagcattttttagtatagtcatagttttccaaccaacaccataatctagttttagaatattttcgtcacccccacaagaaacacactatccatagagtcattcctcattccctcaacctcgccccatcttggccccagccctaggtaaccattaatctttgtgtctctatggctctgcctattctggccatttcatataagtggaatcatacagtatgtggtctcttgtgactggcttctttcacttagcgtaatttttttaaggtttatccatgtgtaacacgtatcagtacttcatttctttttgtggctgaatgatattcttttgtatggctataccacagtttatctgtttttcagccaataggcatttggattgtttgcactttttgacaattatgaattgtacttccctgaacattcacgtgcaagtatttgtgaggacatgtttttatttctcttggagtcaaattgctgggtcttatggtaactctacgtttaaccttttgaggaactgccagaccattttcccattttatattcccattagcaatgtatgtggcttccaatttctccacgtccttgccaacactagttattatctgtcttttgagtattgtaatcctagtggatgtgaggtgggatctcattgtggttttgattcgcattttcctgacgactaatgatactgagcatcatttcatgtgcttattggccatttatatacctctggagaaatgtctattcaaattcttagtccaattaaaaaaattaaactttttatttttgaaaatatttacagccataggaaagtttcaaaatacaatacaaagaatttccatatacgtttcacacagaatttctcagggtttaccccttaccacattggttttacattctcgctctatgcatatggttattttttctgaactgtttaaaagtaagttgtagacaatgctccattacctgtaaatacttgagtgtatttcgtaaaaacaaggatactgacttgtgtaattacagtacagttatctaatgaggaaattaagatagatatagtactataatctacaacatttatccaaattttacttagtgtcccaatgatgtcttttatagcaaaacaaaaggtttttcctctggtccacgttccaatccaggatcacatgttgcattgagttgtcacgtctgcatagtctcctttcacctgaaagagttcatcatcagtctttgtcttttttgacttaatactttccaagagtacagacagtttattttgggtagtcctttgacttggatttgtttatcgtttcctcatgagtacactgatgttatgtatttggcaggaatatcacagaaatgatgttgtgtccttctcagtgcctcataacaagggacacaatatttctgtgtcatcattggtgatgttaacgtggatcatctggtgaaagtggtgtttgccagctatctccaaactttgcccacttataattgggttatttatcattttattattgattttaagagtgatatatacatatatatgtgatatattttttctctatgtaagttctttatcagatatgatttgcaaatgctttttcccatcctgtaggttgtcttttcactctctcgatggtatcacttgcagcacgaaagtttttaatttggatgaagtacaacttacctatttatttcttttgtcatttgtgcctttggctcttgtcttagaagctttgtctagcctgaggtgttctatggtttttatgttttcttccaagagttttatagttttaacttttatatgtttaggtttttgacccattttgaattcatttttggatgtggtgtaaggtaggggttccaactttattctttaacgtggatatgtggttgtcctagcaccatttgttgaaaagactattcttgaaaagactattctttccctgattgagtggtcttggtactctttttggaaatcagttgaccacaaatgtaggagtttatttctggactctcaattccgttccattgttttgtatgtctattcttaatgcaagcaccatgctttctctattactgtagctttgtagtaagttgtaaaatcaggaaatgtgagccctccaacttcgttcttgtttttcaagattgttttggttattgtggatgcttgcatttccacgtaaatattaggatcagcttatcaatttctgtagaaaaatggcagctaggactttgacagggaatacgttggatatctagatcaatttggagagcattgccatattaaccatcctggcttccaatccatgaacacaagatggatttctatttacttaggttttcttgaatttctttcaatgatagttttgtagtttcagtgtacaaattttgtacttcttttattaagtacatacctaaggattttattattttgatactggagtttttttaatttcacttttggatgttcactgataatgtattagaaatacacttgagttgtaaatgttgattttgtaacttacaaccttgctgaactcatgtattagctctaatgggttttattgaattccttagggttttctatgtgcaatatcatgtcatctgcagatacagttttagtttttcctttccaacctagatgcctttattttccttgcctaattatcctagctagactctccagcacaatgtggaatagaaatagggagagtagacatctttattttgttcctgtttttaagaagaaagaagttagtctttcatcattaagtatgatgttagcagcagatttttcatagataacctttatcagattgaggaagttccctttattcatagttcatttgtatcatgtaatttgagaaagtcttaattcattgtgtctcagacaatcattgtcacaacatatttaaagattaggctaggctgggtgtggtggctgatgcctgtaatcctagcactttgggaggctgaggaaggaggattgcttgagtgggcagttcgagaccagcctgggcgacatggtaaaaccccgtctctgcaaaaagtacaaaaaaaaaaaaaattagctcagcatggtgacatacacctgtagtcccagctactcaggaggcagaagtgggaggatcacctgagcctgggaggttgaggctgtggtgagtggtgatcatgccactgcactccagcctgggcgacagagcaagatcctgtcaaaaaaaaaaaaaaaaaagaatagaataaatagcagactagggaatcattggatcataaccttcaatttacagtagaaaaaatgctgccaaatataaattggtgtaaaagtaattgcagtttttgccattaaaaacctaatattaagcagaacatccttttactactacaaaatgtgcccttttgaccctcattcagtactcagtgcctttttttaaaaatacattttaataatttttttattgatgtgtaacgtataaacaagtttgtaatgtgcacttaagtgtacagcttgataaattttgatacatatatacattcttgtacctgcctcccagatcagcaccccagaagttgctttgtgccccttcacagtcattaaactccctccagtgataactgttttgatttttaccaccaatggttagtttcacctgttcttgacctacaaataaacagaatcatgtagtttgtacccttgtttctcacctctttcccttaaaataatattcatagctgggcacggtggcccacacctgtaatcccagcactttgggaggccaaggcaggaggatcggttgatcccaggagttcaagaccagcctgggcaacacagggagaccctcgtctctacaaaaaataaaaaaattagctgggcgtggtggtgtgcgcctccagtcccagctacttgggaggatgaggtgggaggattgcttgagcctgtgaggtcgagactgcagtgaaccatgatcacgccactgcactccaggctaggtgacagagtgataccccatctcaaaaacaagaaacaaaatgaaatccaactgtgaagtatatatcagttcattctttctctgtgtagcattccgttgtgttccaatttatctgttcttctattaatgaagacttggattgtttctgtttgggggttattatgaagaaaatgactatgaacattcttatatatgccttttggtgaacatatatattgatttctattgagtatatatctaggagtggattactggattatagggtaggtttatcttcagctttggttgttgatactgccaagagttttccaaagtggtcatgtcaatttacactcccactagcaatgtatgagagtcccagttgttccgtattcttaagaacagttgatatcatcttttattttttttctgttgagacagagtcttgctcttttgcccagctggagtgcagtggcgcagtcttggctcactgcaacctctgcctcccggtctcaagcaatcttcctacctcagtctcctgagtagctgggactacaggtgtgtgccaccacacctggctaatttaaaaaaaaaaaaaaattgtagaaacggggtttcggccacgttgcccaggttggtctcgaactcctggcctcaagcagtcttcccgcttcagtctcccaaagtgctaagattacaggcatgagccactacacctggctgataccgtcttttaaatcttagttgttctgtgagtgcataccatatgtctcttaagaagcctgacgattgggttatccagctttcaaagattagaagaaaaggtaagatgggttagttagaaaaaagagcattttaatggtttatggaaattatcctgaaatgtacagtattcctccttgacatcttaagagagaattgtgagtaaaaatgttctaatgagtcaagatgacttgtatccaaataaaaactgcacaagtctaggaagtggcccacgtggcccagtagaatttgtgagaaagatttatgggtcaatattaagcttgttctgtgtcagcagaatgatgtggccaccttatgcgtttcctcctcaccattccccttatacaacaccctgtatcttactgagaactagattgtctgtactttgagaggcaatagtccccctatccttagcattgattagatcccctctgaacactggtcttggggccagacttcaagaataatacaagaggctgggtgcgggggctcatgcctcccaacactttcggaggccgtggtgggagaatcatttgagtccaggagtttgagaccaagctgggcaacatagtgagaccccgtctacaaaaaatacaaaaattagccgggcttggtgatgggtgcctgtagtctcagctgcttgagaggctgaggtgggaggattgcttgagctcaggaggctggctgaggctgcattgagctgtgatcacatcactgcactccagcctgggcgacagagcgagaccctgtctttaaaaaaaaaaagaaaaagagtaacacagggacgtcatctgaagaattacctgctagtagagtaactcacacgtcctggggaaaacagtgatgggacagaaaggaaagacttatagggacatggtaaaattatgtgcacttctaatggggtgttaagtagaaaaatggttaattctaagcaaactgtggatggaacccacatgaaagaagtctttggttcagtaaaagggaaatatttctcattaagatcttccaagaatgagctgtctttgggaggtaatgagttctctgttgctggaggtactcaagcatcaattggtcaaccagttggtggagatactatacagaggggattcaggtatcacattggtagttgccctagatttgataaccactaaagtaccacgtcaaatcaaggaggggatcgattgttccatgacttgtaaaagtttggtttatatttaagtacagtttaataaagctaagttaaaaacaaggaatgagagcagttctgagttggcaacgtatttgtgacacttgctgttctagatttttctctttggtcaaagagatgataaccaatacagcaggcagtacggtggagctggagggagagaccgatggagacaccttggaggtgagtcatggacgatctagaatatggaaaacattgattgtgtgttcgatgcttcaagaaaatgtcccatctttctataaaaatcctctgttgagtatgttttatgaacctgccagccatcactgcatggttcccagagataatgttgaatgtgtctccagagaagaatctcatttctttgggattctctcagttagaatgcttaagaaaaatttggccatggactagactaaaatttccttttgtgaacaacctatgaaagttttctctaggctaattagtaatgtctgtgagactacaagagaattagttggccaactgagagcagacgttttatgcttaaaatgactttagttatagctatgtgcatatactatatgaaatataacaactttaaaatcattttaaaaagtaggctcatcagctctttttaacagcacagttatagtccacagttgctaaaccattgtacaggtgtttaaatcttgcccagttattcagatttgccactcactcaggttcttccagtgattacaatttaatgagattttactgtactttcaggttagactgaaaggaattccttaatgtttctttcagaaaatatcaaagggattcattttaataattgagttaactactagaattcttaggtcaggaccagagtttgttgtagaaatgaactgagcaatggtgctttgagggcagcaggtgtgggaatcggagggaggtgtgaggtaaaagtcttctatggagcaggctgattgccagttacatcagacactgatggagatcctttactaaccatgtttttttttttttttttttttttttttggaaacagagtctcacgctgttgctgaggctggagtggagtgcagtggcgcaatctcgccttactgcaacctctgcctcctgggttcaagcgattctcctgcctcagcctcccatgtagctgggactacaggcacccgccaccacgcctggctaatttttgtattttatttatttagagatggagtcttcctctgttacccaggctggagtgcagtggcgtgatcttggctcactgcaacctccacctaccaggtttaagcgattctcctgcctcagcatcctgagtagctgggaccacaggcacgtgccaccacgcctggctaattttttgtatttttagtagaaacgggatttcaccatgttggccaggctggtctcgaattcctgacctcaggtggtctactcgcctcggcctcccaaagtgctgggattacaggcatgagccaccacgcctggcctaatttttgtatttttagtagagatggggtttcgctatgttggccatgctggtctcaggtggtcctcctgcctgggcctcccaaagtgctaggattacaagcatgagccacagtgtccagccaaccctttagtaatcttaattgtcatgaacatccctagaagtagatgggaaaggacacccacatacccgccgactattccgtgtataagctgcacttctgtaagtagaagcagtggagcatgcaaaataacagaaaaaattgattgctgcctctctgctttaaataagtgttgctcagcgtacagtcacatttgttttaatcatcgagaagaatcaaatgcatctgtatgtgacagcttttgatgggaagatgggggaacaaaatagtaatgctaattgtaaatcaagtttttgtactaggtgtttactactagatccgtatgcctgaaagagtggggaagccccagcatatttactttttgtattaagataatgttaattatattgaccttcaattcctttctgggttattgaaagatatttgtttcctgacaacttgataagggattatgcaggaagacacctagttgggttattcaacatgcttagaagcagttttaaattgcagcgttaaaatggggaagaatttccaaaaggtgagccaattatatgcaaaccatatttttaattttcttggattccatttcataaagtcatactatgaacaggtgaacaatggagaattctgcccctttaaagtcatttaatgaaaagggcctaagctaagcactgtgacttgcctgacagtcaaataatgttatttatattttttttagttgctagacaactctgggggccttagagggcttctccgctacaagttgtatgcttttttgtccttttgtttttccttcttcagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggcaagtccaggcgggccttccgcatttcgggtgccgtctccacaccccagatcccatacccaccgctcatggtgtggaggagttaagggcaaaagcattgtgttaccacaaaacctgtcattctcttgtaataggggtgatcttttttttttttttttttttgaaacggagtctcgctctattgcccaggctggagtgcagtggcatgatcttggctcactgcaacctctgcctcccaggttcaagcaattctcatggctcaacctgtagctgggattacaccatgcccagctgatttttttgtatttttagtagagacggggtttcaccatgttggtcaggttggtctcgaactcctgacctcaagtgatctgcccgccttggcctcccaaagtgctgggattacaggcatgagccaccgcgcccggccagggtgatgtgcttttgttttgtgtattatagattgagaaaatggaagaactacacttcagaggcacgtggattgcagaggatcatattttaaaagaaaacttttgttgtgtttccacccattggctaggtctaaagttttacattttttgcgtagttgtttgcaaatatatatacatttttgagatgaagtctcactctgtcactcaggcaggagtgcagtggcagatctcggctcactgcagtctccacctcctgggctcaagtgatcttcccacttcagccgcctgaggagctgggactacagacacacgtcaccatgcctgtctaatttttgagtgcaaatataatttttaaatattactgggttattttaaatttacattgtagcagttgaaaatggctatgatttgttcagatgcatcattgtggaaaattacatgcagataaaaaaaatcagatttttgcagtacagaattttttttaacatcctacccttcaccctcacacatggattttggactgtttttctaccatgagtactgcttattcatttctttgactttttttaattttaagaaatgtttgtttctagccgggcattgtagctcaagcctgtaatcccagcactttgggaggctgaggcgggcagctcacttgaggtcaagagttcaagaccagcctggggaacatggtgaaacctcgtctctgttaaaaatacaaaacttaggtgggtgggcatggtggcgcacacctgtagtcccagctactctggaggctgaggcacgagaatcgcttgaaccccggaggcagaggctacagtgagccgagactgtgccactgcactccagcctgggtgacagagtgagaccctgtctcaaaaaaaaaaaaaaaagtttaaatttataccccaacaaaatgagcattgcaatgttgactgcaaagtgtttctgtagagaagctacatacacagttggaattaatcattccgggatccacaggtgtgtcagaccacagctgtaggattgccttcagtgtcgagtgctgaagaataatgtgtaaacacccatgtatctgggtgattgctgatatattggggatgagttttaagggatttctgccagctgtaagacccttcattcatccattcatgtatttgttgattttcagtgggatagcatgttatgatacgtgaattatgagacaggacctgaaatgaactatttccatttcttcatttcaccaataagaaaatcaagactgaggaagattaaatgactttcccaaggatgcttagaaacaagactaggatccgagtctcttgagttcctcatccagcatccagtctcttttctcatgatggataaggtgttgcagttgtatctatttggggaaatttctggcatgtcccatctccttcatttggtagcaatagctgttctagctttttgttgctgatcagtagttcctgggattttaagagctagaagggacctttagagactgttttgttcaactccctaaatttataggctgaacttatgatgataggtactttctctgtgtcagactctgggctggcactggggaccgaaaggtgattaggatagtgtccttttcccagggttctgctggttcggtggcaaatgcagatgctttgcctctgagtgaaagtgccaagtgccatgatagaggagtacacagagtgtttttagaacgcagaagaggaatgaattactctccttagtgagttgtggcaagtttgaaaaaatagatcaactttgagctgcactttgagggatgagtaagaatttgtttagcggaaaaggaggcctatgctgatggaaaaacagagctgttaaaacacaaagtatattcagagaacaacagattgtctgatatgacttgaatgtaggatgcagggcagtgagatgctcttgaaatgaggccaaaaaaaaattttttaaggcttagcctgaactgatctttgaaagtccttgtatgtgacattaaatagcatggtctctatgtggaatttatgtggggaagggatgtggtgaagtgtgtgttttaagaagaggtagtataatggccaaggttggggaatggattaaaaaggccagaggctggggctgggtggcccattaggtggctgctgttgtggtctggggcgactctgtagaataagacgagagggcagctgagggcagaaccttccagaacaccactcttcatgggaggcagaggaagaggggctgttgagagaggtaaagaatggttggtgggttcaggcccgaaaaataacagtagtaacaatagcagtcattcattgaatactcaccacacaccagctactccactaagtgcttaatgaaatggacatgccttggcccctggcagccctgcatggctgtaggcttatcctctattgtacagatgggaagttgaatagtttcatggaagccagagaaaagaaagtttccagaaagaagggatgggcagcagtggggcaggtcctggtgaggtgagatgtggttctagagtccctgggatttggcaggtgaccctggctctgtttttcccaataggtattctcagcctctgcacgaggagatagccctgcacaagtaccttaagcaccgcaatatcgttcagtacctgggctctgtttcagagaacggctacattaagatatttatggagcaggtgcctggaggtgagtagtcgctgtcttctggtctcacattctgaaaatcactacgacgtggatgtcatttgttgtcctgccatttacaaaatgacagacccctaagccaggcctgtagggcgcctgtagtcccagttacttgggaggccgagatgggaagatcacttgagcccatgaggtcaaggctgcagtgagccatgatcacagcactgcactccagcctgggcgacagagcaaaacccatcactctttttaaaaaaaaaaaaaaaaaaaaaaaaaaaaaaaaaaaaaaaaaaaaaagcaacagaccctttagatgttggaaagttggatactttccaaatgtcatataagcagtctatttctggtttgttgatgcagtttgttcaacccacaaatattcattgactgtctatggagaaaacatagtctttggccttgaggccttcacagtctaggagtttaaaggtgggtttggacaagggtgcagaagagggaacatagatgttaaaagtgacagtgcaaaatagcattttgataatgaaatcaagcatcagtgttttatccacaaaaatccctgaatgcaagagatagggcacaggaggggagttcctgggatctggacccagaccatctagtctgagtccgttcctccatccacaagctgtgtgacttcaggcaaattgttatacctctctgtgccctcagttttctgattgaataaatgaactgtaaaattggagtaataatgactctgataattggagtaataattattggagtaacaattaacgctgtctcagtgggctgttgggtggattctgtctggcagagaacaagagctcagtaagtgctcattgaaataatgaatcaaactctttaattaaataatagttatctgaatacagatgttaaaacttcagttagaaatcttcattcattcattcaactgacagttattaagagtctgctattacaggaagagtcttaagtatatttattaagagccaggcagtcagccaggcacagtggtcacgcctgtaatcccagcactttgggaggccaaggcaggtggatcacttgaggccaggaattcgagaccagcctggccaacatggagaaaccccctctctactaaaaatacaaaaaattagccaggtgtggtggcgtgcgcctgtagtcccagctactccggaggctgaggcacaagaatcgcttaaaaccaggaggaggaggttgcagtgagccaagatcataccactccactccattctaggttacacagtgagactccgtcttcaaaaaaaaaaaaaaaaaaaaaaaaaaaaagagccaggcagtgggctagattttcagggttatgttagaataaataaagtagtttgtctttcccttaagttggtcatagtctatcagaaaactcgtccattgctgctttttctttttttttttgagatggagtctctctgtctgttgcccaggctggagtgcagtggtacgatattggctcactgatggcaacctctgcctcctgggttcaagcaattctctctgcctcagcctctcaagtagctaggattacaagtgcgtgccaccacgcctggctaatttttgtatttttagtagagatggggttttgccacgttgaccaggctggtcttgaactcctgacctcaggtgatctgcccgcctcggcctcccaaagtgctgggattacaggcgtgagccaccgtgcccggccccttactcttcacgttagttgataaccccatccccggcgttaggtttaagggtatcaacagaaatagagacagatgtgttcatccccttttatagatggggaaaccaaggtagatcaaggtcccataacactgtgtaagtgggaatctgagaccagccgatgtctgagggcccgttcctgccaatggacaggacatcccgcagttcacatgatgtccttcgagacgtggtcacagtgtccttaagggagcttttcttttggcccaaatgttcagtgtttaatagcgtaattgggggaagtggttgttgatcaagacagtcctgccctgagacttgccactgtggctttctcacattgaggacagagagacccaacttcctccagtcctagtccttgtcaccctaaagggcccctcactgtggacctgtccacctctgattacagacaaggtataaaacgtggctttaacccaagcagaatgactgagacagacctgctgtaaacaagtgtcatgggacctgagttatctacgccagcaggccatgcccctcaagttgagagagcattatttcgctctcctcctaacttcatgtagctgaacagagctaaacccacaattggccccactgaatttcagggggcacaaggggttcatgttcaccctgtgcctctggttaggttcatgtgctcaattgcttccagtccattccctggctgtagctacagaggggaggaaacatgttgcatttagcccagatccgatggtgttggtgtaagcacttaggttaggttagaaacctcacctcactttatttccctgaacttttattgaaactttctcttcctgataagttttttgctgtgactgtctctaggaagcctttctgctcttctgcgatccaaatgggggccgatgaaggaaccgacaatcaagttttacaccaaacagatcctggagggccttaagtatcttcatgaaaaccagatcgtgcacagagacataaaggtacttgcttttttaagctgacgaggttgcctttgctcgtatcagatcatgagagctgtcgatggtgtctgctgagtgactggctgacagaggggtatgatttagcacaaccgtccccaaaatgcaaagtctagttttcctagagacttgtgacggtttcccaaggtccagatctgtttcatatgagttcgtttcagcctgtcttttaagcacttgatgatgttattttccgaagggcgataatgttctggtgaacacctacagcggagtggtgaaaatctccgattttggaacctcgaaacgtcttgcgggtgtgaacccctgcacagagacttttactggtaagtggaccaaagcttggcacagggtgcccatcccagagttacgctttctgcacaagctgcggttgttcagccgttacttagtgagcaccttttctgagcagagtgagcaattgatacttgaagtagacagtggattgtccccaacttcaaattgttttaactttgtcatagtgatgcacctagccagctacttgtggcaacaagattgccctactttcttctttgtcatccaaaagttgggtagatggagtgctctgctgaggttctgaggttttcttttcttttttttctttttttctttcttttttttttttttttttttttgagacggggtctcactctgtcgcctaggctggagtgcagtggcacgatctcggctcactgctacctccacctcctgggttcaaatgattctcgtctctcagcctcccaagtagcttggattataggcgcgccccctaccacacctaattttctattttcagtagagacgaggtttcaccatgttgaccaggctggtctcgaactcctgacctcaagtgattcgcccacctcagcctcccaaagtgctgggatagattacagatgtgagccaccgcgcctggcctctgctgaggctttctgaaggtcactcaaccaatcagcaagatggcagcacatctctttaaagttaatagcacattatctgaaatcgtgggtaatgctgaataacagtattcctcagacaactgattaagacattttattggtctgtcataaaaatagcctgttactgtagtgaattctggtaccttgtgttttgatatgattgtgtttccaagagaggctaattcttcctggggaatatggtattctaagtgattttgaggaattggattttcttgtccatgtgtcagtaatggaataacttgagcattgagagggactgggttcaaagggtggtatacaattaccagctagtttcacagttgtaagatcaataagtagaatgatggtcaaaagctacttgtggctattggaaattcctgcttaaacctgactaataacaagaactttgatccttggaaagaagtactgatttttgaataagtaaaggtttatagtcccccaaggagtaacgtaaagatcacaaagatcttgcttgatggaattatgaaacagctggggcctggtatagtggctgacacctgtaatcccagcactttaaaaggccaagatgggaggatcacttgaggccagcagtgcaagaccagcgtggtcaacatagtgagaccccatttcttaaaagaaaaaaaaaaaaacagctttcataggctgggcactttgggagattgaggcaggaggatctcacttgagctcaggagttcaagaccagcctgcgcaacatagggagaaccccatctctacaaaaaataaataattattattattacatattatatttatatattatatgttatatataatataatacataatgattatatataatatatgtatataacatatattatatagtaattattagctgggtgtggtggtgtgcgcctatggtcccagctactagtgaggctgaggtgggaggatcgcttgagcccaggaggttgaggctgcagtgagctgtgattgtgccactgcactccagcctgggtggcagagtgagactctgtctcaaaaaaaaaaaaaaaaaaaaaagaaaaaattagctcttaaaataatatagctctgaaataagctataaaagacaggtgactgttctctatctctgcagtcaccaaagctgtagggtggacagcttgggtcttatttttggtaaataatgtgtcagctttgaaagactttttgtcaatgagagagttgtcgcgtgtcagccactggacacccacagtggagacacattcaccatctaaagagaattttaatacatcacaaaatgacttctcacttgtaacacaaggggaggtacatgtgcctgaaaatgggaaaatactataccagggacactatcagaatctcccaaagaaagagtgcattgaattttcattcattgtttctggtataaatatacgtatacatctgtcaatgtgtgtatatgaatatgtgtgtatgactagcacttcattttcttttagcattttactaccctaattgaaaatgacttgtatcctcctctttggaagccaccaattagcttggcaatacatagcaagaggggctctgatatgacaaggagttatttgaagacataaaacccccaacaatttatctcataattagcttccctgaggaggaaacaaactcacaaagaaacacatgtataattcatccttgcatatcacacttcccaagtaattggcttggggaggcacggattttgcattgcaaaagaatgcaggggtgtttgggggataataaggaaggggtctcattttggttaggaaattcccccgcatataattgctctttgcaaaacagagcagttctgtaaggaaatctcagctggttggtgcagaactctgggtctgtggttgctcagcctggcaggagagccagagggtttcagtcaacttcctggcctggagccctccctccctgtgttcctctgaagggtttgccccacacataggaacctgcgagaacaggaggaagggctgttatagccagggtcagccctgccttttttttttttttttttttagcagccttatcgaggtatagctgacatatcatcaaagcacccattagaagtactcaattctttggttttcagtaaatttactgagttgctcagccatcaccacgatccagtgtctggacctagcagaccccgtgccccttggtactcatccccattcccactccagccccagctcatcactcatctgctttgttgtgtttgtgtggctttgcccgttgtggatattcatatgcttggaatgaatacaatatgtggggttttgcatgtagcttcttgcacgttgagtcctgtttttgcagttcctccatgcagtggtgtgtatgggtacttcgttgttgttcatggctgaatggcattccattgtgtggagaaccacattttgttcatccgtttaccagttaacagtcatttgggattgtttctactttttggccactgcgaataatgatgctgtgaacattcacatacaaagcgtgtgtgaacatgtgttttcagccttcttgggtagatacctagagggagaactcgggacaggaagtctgttctcgtctggctgcaaacatcgttggttcaaatcctggcccaaccacttgctagctgtgtgaccttgggcatattacttaacctccatgtgcctcagtttcttcgtaagtaaaatagaaatgctcgttgtacctactcatagggtttttatgagggtaaagtgagttactgatgaagtgctttgactggtccctggcacatagcaagtgcaattgaagtgtttgctaattaaatactcgcttgtacttagaagtcatgggttattagagctggaaggagcctttgagagaactgagtttgtgtgtgtaactaacgtgttgaacccattggactcaaagggtgtaatcacaaaagccactggatttttctctcccacttttcatcctgcctggggcgggagttctttcctttgacttttccagccacccttacataacagagaaagtcataatgacacttgaaggagcgcacacagtctgaattcaggaattaaaaaggactcatcgcttgaagccgggaggcggaggttgcatgagccgattgtgccactgcactccagcctgggtgacagagcaagaccctgtctcaaaaaaaaagattcaggctgatactgatcaacgctctggtcctcattcaaaagtcagacccctctcccgtctccctgcaggcagcgacctgtggtcaggagctgggtgttgtctttttctccctaatcaccagctgcaggaaggagaggacaggggcagggaaagttgttacttgactagcactgttggaagctggctttgcgtgctgtgggcctggctgatgtttagttatcttccctcgctggctccctctggatgtaactcctgtgtcgtgggcaggggcctgtcctttggctgacagccccctcctcccagttatttaccccttacatcacctcctccttccatctctttctgttgagggattcagatcgtggaggactgcgtttgagcaggaattccttttcttttttctttatttttttattgggcagcccctggaaccagaataggttctgagagagactcccaggattccttttaagaagaccatatgctgggcacgcctgtaatcccagctctctgggaggctgaggtgggaggatcgcttgagcccaggagtttgagaccagcctggccaacatagtgaggccccgtctttaccaaaaatataaaaatcagctgggtgtggtggtgcgcacttgtagtctcagctactcgggaggctgaggtgagagaatcacttgagcccaggagaatgaggctgcagtgagtcataattgtgccactgcactccagcctgggcgacagaatgagaccctgtcaatcagtcaatcaatcaaataaataatacaaataaaagataaaccctaaggcagtatttctgtaatagggtcccccatctggtgtccagagttcaagcagcttcagcccactgttgagagggtgtggcagtatccccacaccttacagccccctgtctgctgctggaagttaacctttgctcacttgggtgccagtccactgtgtaatttacctacaggaacacatacacatggagctgagtcgctcagtgaagcccccttcaaaggctttgggttaggaacaagtggcgccacctttccaccaggcttatcccttggtcaggtcaactagggtagtcccctggactatgggaaaatcgtaccttacttttcttttctgtacttgattaatatgaaatcttgaaatttaggctctaacggtatctccaagggcctgtggaagatgtgatgatcataagttggtattgagtggcttgagttgccctgggcccacgcccttttggggacagtcctgccccaaatcctgtaacttgggagagggtaggcagcccagcatagctctctctaaagaagctgtctcagcaccacccccctaaactactctgtcaactctctcagccccttgatcagattagaaggtccctgggcctcggttataaacttgtgtcttctgctgtgtgtcttctttgctggtaatctgaaaatcctattggacaattctccaggagtccccagtggattttgtgccctaggggggctgagtcagtgcctgtgggtctcttggtcaccttgttctgaactctgcaccactgcactggtgtaggtacctaagagccgtagtgggctgtgaccagtgaccagtgtggtagggcataccttggaggaaatataggttagggagcatatggggccccaagagagccagatttttgtttgtttgtttgttttgttgaaatggagtcttactctgtcgcccaggctggagtgcagtggcgcgttcatggctcagtacaacctccaccacccgggttcaaacgattctcctgcctcagcctcccaagtagctgggaccacaggcacacgccaccatgcccggctaatttttgtatttttagtagagacggggtttcaccatgttggccaggctggtcttgaactcctgacctcaagccatccacctgcttcggcctcccaaagtgctgagattcaggtgtgagccaccgtgcctggcctatgagagccagattgaaggaaacccaattttccaggatttgtgcgtgattcagatgccccacaatgccatcttcacttggttttcttgacagaatccagcctttgggttagctgatgtacacacccaacatgcatcctgccagggagtgttcccttgagtatctgaaatagttgtgtgcatttatctctctctgttagctgttctgagagtggatggttaccttgtgaatacagtagtgaataaaatggagcacccagttttccattagtgccctgtaccttccagttacatggaaagatgctccaatatggctttggaaatccttacacgtgctactcttattcaggcagctttttttttccagcagcgcttcttcttgatgtagtgtatggatgagtgatgtcatggtgtgtagttctgaacttgaaggtagaagatatgggttctagcctaagcgaatcctttagcctctctgaacctcagttgcctcctgtgtaaagtaggaataatggtagatagtgcttcctctgcctaaccttccagagtcgtttgagtcagatggacaaggctatgtggagacaattggtaagccatcaagtgctcaccaggagtcagatttgtggcaggcagcctccaaaatgacccccaatgatccctacctcctgatagtcacacccttgcgtagttccctcccgttgaatgtggactggacttagcaacttgcttctgatgaataggaagaagtgggagtgatggtgtgtgacctggacactaggtcataaaaggcagtgtgccattcctctttctctcggatcagtctctctgagggaagccatgtctcaaaccagtcctatggaggatcccatgtaatgaaaaactgaagccccccactagctctatccttagtgagcttggaaactgatcctccagccccagtccagccttcagatgactgtagccccagctgacatctggactgcaacttcctgggagaccctgagccaggtccacccagctagttagttgctgctggatttcaacccttagaaacgctgtaagacctaactatttgttgtttgagttgatagatttgggggatcatttcttaaacagcagtaaataactaatatgaatgtcattattaaatccttgcctttagaaagagtgctgttcaccatggctccatatttttaaaaatctgcaaatttatttttaacttttgtgggtatatagcaggtatatatatttatggggtatatagactattttgatacaggcacacaatgtgtaataatcacatcagggtaaataaggtatttattacctcaggcatttatcctttgtgttacaaacaatccagttatgctcttttcagttttttaaaatgtacagtttttttttttttttttttttttttttttttcccctgagacaaggtctcactcccatctgcccaggctggagggcagtggcgtgatctcagttcactgcagccccaacttcatgggctcaggtgatcctcccacctcagccttccaagtagctgagactacatgtgcacaccaccaaccctgactaattttttgtacttttttagtagagatggggtttcgctgtgttgcccaggctggtctcaaactcctgggctcaagtgatccacccacctcggcctcccaaagtgctgggattgcaggcatgagccaccatgcccagccaaaatgtattgactatggtcaccctgttgtgctatcaaatactagatcttattcattctttctatttttttttgtacccactaaccatccccaccttcccccagtccccactgcccttcccagcctctggtaaccatccttctactctccatgtccctgagttcaattgttttgatttttagctctcacaaataagtgagagcatgcaatgtttctctttctatgcctgacttatttcgctttatataatgatctccagttccatccatgttgttgcagatgacaggatctcattcttttaatggctgaatggtactccattgtgtatatgtaccacattttctttatccattcatctgttgatggacacttaggttgcctccaaatcttggctattgtgaactgtgcttcaacaaacatgcgggtgcagatatctctttgatatactgatttcctttcttttgggtatatacctaggaatggggttgccggatcctatgataactctatttttaggtttttgaggaacctccaaactgttctccatagtggttgtactaatttacactcccaccaacagtgtatgagggttcccttttctccacatcctcgcccgcatttgttattgcctgtcttttggatatcagccattttaactgcagtgagatgctatctcactgtggttttgatttgcatttttctgatgattagggatgttgagcaccctttcatatgcctgttggccatttacaaatgtcttcttttgagaaatgtctattcagatgttttgcccatttttaaaaatctaattattagatgttttcttatagagttgtgtgagctccttatatattctggtgactaatctcctggcagaggggtattttgcaaatattttctcccattctgtgggttgtctcttcactttgctgactgttgcctttgctgtgcaaaatctccaaatttagaattaagcagactaaataggcttcaattaggaaataattgtaccaggatggacagttatttgaccagagccaattagccattgatgtttggtttagcgtttcttttctactgctggatacatctataaatgtattctcttgctctttgaagaaataaatttagtgattatattagtcagggtccaggcagaaaaacaaaaataaccccagttatttccatggagagaatttaatagaaataactgtttgctggttaccaaaaaccagaaaggcagaaagggaggccctgaggtatcaggaagcctgtacccctggggcttgggggtcaaatgggagggtgagattagaacttgttcggagggagtgtcaccaggctggagcaggtacctctgaggggcaagatgaggctggttctggaagtacggggtgacacacagcgggagactggggccgactgagggtccaacgccaagcttagggccacagcaagcacacagcaggtctccgcttcctcccgcatccttccagggtctctctttagcgccacctggttgcggagcctaatggggagctgcaggcgaagcagagtcccagactcagcatcacagagcagagctgagagagggtagcttcataagcagcacagtatcggatccttcctcaattagggattcgttagaaggcacattccctgccaagacctctccctctgttacagcagcaagagcccataggggatattgtgtcatcggatgttcccttcttggggctctgggatttcctaacagggcatcaagtgtaatgcgctgccatgttgcccaactctgcaactcactgaacatttccccgccagggcatcagctctggagaccaaagccatcatttgttcctcatcgatctgttgtgctcactgatacaacccaattcatatttaagtttatatttaagtcacttgtaattgaatacaattaaaacttaaaaatgcatttcttcagtctcactagctacatttcaagggcccaacagtcaaatatatgaggctagtgactaccatatttaaccacacaggatagaacgttgccatcagcgcaggacattccatccgtcacagctgcccctagagtatttaaagaatgctaataagacataggatcttccagagggggacacaggaggtagtttctccaaactttctttatagccagtgcgccctttgctttcctttttttttttttttttttttttggagactgagtctcgctctgtcgccaaggctggagtgcagtaatgcgatctcagctcactgcgagccaggttcaagggattctcctgcctcagcctcccgagtagctgggattacaggcacccaccaccatgtctggctaatttttgcatttttatatttttagtagagacggggtttcgccatgttggccaggctggtctcgaacttctgacctcaggtgatccgcctgcctcggcctcccaaagtgctgggattacaggcgttagccaccatgcccggccctgctttcattgattaaacctttagttgtgtaatcctcagataggcctttgaatttctctgggtttcagtgttctattcatgcgtggccaaggtcagagctctgactttgctgtctttttctaaatttctttgccagcccccaggagctgctgtcactttcacacacgtcccctttgcacaggctgagtttcaaggaaaacgaaggatgttattcgcagagcccttgactgacctccccgtgtgctgtctcccacaagagcacgtccaaagccagagccctgggcccaccctgcttgccactgggcctgtgcccttgccattgcctccttaactattcccacaccctgccccgtgtcagacatcgcttgttccccggaccgctgtctatctcacacccatgatcccctttgtccagccctccagccttcgcagcaggaccctgcttccctgacagccccggctaccaacccagcaaagttacactttacccaggctgctccccaccaaggcctgagcctggcaggggtgctagaacccaggtgggactcctccagtggatgacttggggctgcagactccccagcagcctggctgaagccctctccgggctgctctcccatcccagattcttcctgattctgccttcctctccgctcccaggtgttgcacctgccatgtggtccgcagccggccctgcccaccctgctccctcccgctttgtccttcagagaccttctccccaataaatctctcatatgtctcatctcgtcttggcattttactcctcagaggcccaaatggacacagccatagtgtttcctgacccgaaccaggcagagagtcaaaccctattttattaatgctcttgcagccttctgtgtatttctctgtcctagcacctaccacattttgccattactgccaccgctgccagcattctgtctttgtctcctccactaggcacctccctaccatcaggctgtgtttctcacgttctggcttccctgtatttggcatgtactaatatgtgctgactgaattgcgccatttgtcctttgatgggccaggcagtcctctctccacgtggttagtattaaaggaaggcatgttgcatgcctctgctcaaagaaatatgcagtcaggccaggagcagtggctcacgcctataatcccagcactttgggaagctgaggcaggcacatcacctgaggtcagagagaccagcctggcccacatggtaaaacctcgtctctactaaaaatacaaaaattagccgggcatggtggtgtgtgcctctaatcccaactacttgggtggctatggcgtgagaatcgcttgaacccgggaggcggagttcgcggtgagccgagatcacgccactgcactccagcctgggcgacagagcaagactctgtctcaaaaaaaaaaaagaagcaaccatattatttatgcatgggacaagactccatctgccatttgtgaagccattcatttcacagttagtggtgggttttttgttttgttttgtttttgagacaaggtcttgttacattgtccaggctggtctccaacacctgggctcaggtgatcctcctgcctcagcctcccgagtagctgggactacaggccacttagtttctgagcaatatggtacccacagcctgtttgtttgttttccaaataggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtaagtcatgcttcgtgattgaggttgggcgtggttgggaagtagaattaaaaacaaagtctcctcccaatccagaaaacctctccacaaaggtaggagagaaggaaacagttttattattggataagcattaaaccagaatgcgaggtgcatcacaggcaatccactgagactgcaaagatggaaagcaatctcactgtttcatagagccgagcagacacaacccgtgacatctgtgttctcaagagaaaccgtaactagtcctcaagtaagacaacttggtggtgccatttgtcacaaggagctcatcttagattcacctggtgattggggggaccattggtgttcactgtttggcttcatccaaaggaaaatataggccgggcgcggtggctcacgcctgtaatcccagcaatttgggaggccgagatgggtggatcacctgaggtcaggagttagacaccatcctgggcaacatggcaaaacctcgtctctgatacaaaaatcagctggacgtggtggcgcatgcctgtaatcccagctactcgggagactgaaacaggagaatcgcttgaatccaggaggcagaggttgcagtgagccgagattgcaccactgcagtcccgcctgggtgacagcaagacactacctcaaaaaaaaaaaaaaaaaaaaaaaaaaggaaaaacactaaacttctcatatctttaagacagtaggtagttttggagtgaagccaccatcaaagttagaaacctaccttcctatttctgggagagcagagttatgaaaacattaataaaagatgacaggtttaaaaaaaaaaaagaaaaaggaaactaggagatagaggccctatcttctttgatgattacatttcagagagatggcttccaggtccttgcaaaagacatttctggcaagagtcttatttagccgtttaaaagattcacgtatatctcagagacagagaaagaaccttaaagttataagttctctcaagtcaaggctctaagaaagctgggcagggtgggggagggtcctttccctttattttcaacagggagaatccagccccttagtttcccttcatgtttgctcttacagtgggtaaggctcaaaggccatgtgggatctgtgcctttgggggacaggtttctgactggcttctggagaggtgggagttgggctatcaggtaaatatatcccttatcattccaacaaccctccccgagctaacaggaagggcagcccatgtactggggccaacatagtgcagattgagcattgcgggtgggggttttaccgccgagcagccaagattgtggaaagggatgtccttccttgtgacctcacgggaagctgatgccaggacaccccggtgtacccaaggttgggtgtgcagcttctggcctcatgtatgcttagaaacatgtaaggggcttgatgtggtttggccatgtccccacccaaatctcatcttgaattgtagttcccataatccccacgtgttgtgggagggacccggtggggataattgaatcatgggggtgatttcccccatccagttcttctgatagtgagttctcacgagatctgatggttttataaggggcttccgcctttgctggttctcattctctctcctgccgccctgtgaagaggtgccttctgccatggatgtaaatgtcctgaggcctccccagccgcgtggaactgtgaatcaattaaacctctttataaattacccagtctcaggtatttcttcatagcagcatgagaacagactaatgcagagctctagccctaggatgccattaccagcactgaccttccatggggcactgccttgagacagcagggtcacaaaaggccaaatggccattgcttatggatgatgaggccgcagtgtgtggacacggccctgatagaacgcgattccagaggcgtcttcctggcttctctgccaaacacggtgccttcatggcctgtgtctgtgccaggctctctgcttccctcttgggcagaaggaacttggaggtgtgagtgcaggtttctgccggttgaggtgagggcagcatgttcaatgggtcccgagtgctgcctgcttgggtgccttggctgctctctccagcccggcgaggcccctgcagaagggtctcagagcttctcacctcctatcagctgcttgggttcagagcccaggccaagacctcaagtcgacaagagtcttctgatacctgcaatcccaagaggaccctcagctcctgggctggaagacagcaatgaccgtcctcagcactttgaccgtgtgcggtggaccctgttggggccgttgtagatctaacctgcagcttccatggcagcgttggaataaacagcagctggtgacgaggaaaacatgaggcccacctgagagccatggctggctgctttttgacctgctgctgacttccgggaaaccagggagagagctgaaggctgtgactggctcgattcctccgcagggcatgcctggctccccgcctcctcttgtttttgtttagcgaattcactgtacaaagtctctctttttttttttgacagagtctcactctgtcgcccagactggagtacagtggcacaatcttggctcactgcagcctctgcctcccgggttcaagcgattctcctgcctcagcctcccaagtagctgggattgtaggcatgggccaccatgcctggctattttgtatttttagtagagatggggtttcaccatgttggccagactggtctcaaactccagtgatccacctgcctccgcgtcccaaagtgctgggataacaggcgagagccaccgtgccccgcctgtatgaagggtttgaaaatgtactgacttttttggatggcatatgaagtcacttttcattgccaatgagaaagttattattaaataagtaatggcccctgtgttatttctgggatccttcattcctttagaaaactttcaagaaacttctgggcagtgtctgaaacaaaggacactctctttcccctgaagggactgttacagatttaactgtgtcacccaaaaatgatatatggaagtcctaacccccagtacctcagaatgtgaccttctttggaaatagggtctttacaaagaaaatcaaatgaaaatgggttctggaatgtgggccctaatccagtatgactggtgttttggactttttttttttcttttttaaatctttctttttattttttttaactagtcaagtgaaacagtgggagtggggaaggaacaaagaaatctctaactggttgtcatcaactagctgcaaacaccactgcactcggaccagcctggtgtcttttaaaaaggggggatatttgagccaggtgcattggctcacccctataatcccagcactttgggaggccgacgcaggaggatcacttgaggccaggagttcaagatcccccggggcaacatagcaagaccccgtgtctacaaaagatgaaaaaattagcccatgtggtggtgcacacctgtggtcccagctactcaggaacctgaagcaggaggatcccttgggcccaggagttggaggctgcagtgagctatgatcatgctactgtattccagcctgggtgaccaagtgagaccctgtctcaaaaagttggggggtgggggtggagatttggacacacatgctcagaagacaaagtacgattcccaggggaatgcctcggggaggcagaggagagaggggggtgcatctaggagccaaggagcgccagagaccgcccgcagaccacgagaagctagaagaggcaaaggcggggattccctgcatgtttcaggagtccctggccctaccaacgcttggatcttggacttccagcctccaggactgtgagacaataagcacctgttgtttcagccacccagtttgtggtattttgttacagtggccctaggagaccaatacaaggagcttttgggtcacggcaaagcacccttaaagaggacatcccagccgggtgtcattgtgctgcccacatttgctgttttcagagagccgggcagaggccaccctttccttttcatgttcttgcctgaatgttggtctttgtacccctagtgcctgtgaacagtgccagcttaacctccctaccgctcaggtgagaggagccacctgtgaggcaccctgcattgcagacctggcggtgggtgggatttcacccagcatttagtgttcttcgaatccgtaactcctgagctgggcagcctggccaggaggagcgctgtgttggaaacagcacatggccgtgactgccaggtcaagggccttggggacaggaagtggggaggcctggccctctacactctgcagcaccctgagctcactcggcggggattgtggaggctgagccagcccccaggagctctgaggagctgggaatgggcatgggtctggaggacagaacagcttccacgcctggattgttgggtgggcttggaaaagacacagggtggactgtgaaactgaaggtgacaactcctaaaaagatgagagggccaccctactgggaacagttatgaaggagggggctatataacatgtcacggaagcatgtccgtgtcacagcgagatgtggcagctcagaaccaactcttacttccctacaggtcacagggacagagagccattagttacctgtctatacattggcagcctcaaggttttgtctgcttgtggttttgagctggaggctgggaatctgggctgtggatgcagagggattgagaggtgttaaaggcatctcttggggaccctgtgcgtcagggaacaggtaacagatgcctttgagtatccttagaggacatgccgccctaggctgtggcccaagtcccatctcagttctctactgctatgtaccaaaccaccccaaaatttcagaagcttaaaacgatgactttttctcatgcctctttgagctgactgttggctcttctgtgggttttgcctgggctcactcacatggttgcagccaagtggtggtttgggggagcagggtggcctgagaggcccctccctcatggcagttccagctgggatggctggggcgtcctctccacggggtcgtacctcctgggcttcctctctgcatggtggtctcggggctttaagggtgactagcggagccacaagacctcttaaggcccgggccctgaaactctcaccatgtcacttctgtcactatctgttggtcaaagtcaagtcacaagatgccagtgagggggaaatggactccaccttggggtgggaggaacaagaacgtgacgttgcaagggggcatggattatgcctgtcctgggatgtcaggtgtacaggagctttggactgagacatggatacctgaattcacccaaggcctcactgacacatcggttacctctcccttaaatgcaggtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcaggtgaggcctccctggacagctggggcagcaccctggccacaagaatgctgggcgctgggcttctctgctgctcaggagggagagttctggctatccagagccctgggctgctcacgtcattcccatttttgtgaagagtgacggggcctgtgcagtaggtttggaggttgtcaaaatccaactaatacatgcacctcgatctcctgacagaggcccagggagtctctgggtgactgggctgccgtctgctggaagttgttccttcgggattgggaagagagtggggaggcaagaggtaccccagctggggttctgcgtcttcaccatgtgccagagcctggggcttcagttttggagcctggcttgtcatcgtgtgccaaccctgaccttgattaaaggatttgtcagggaggtttgcctgatgtggctgtcctgcaggccaccgaagtccagtgacaccttctggggcagtaagtcctaactggcaatgatgtaagagtggcccctgaaaaggaagcagtttgtcctcttttccctggtaccgatcggggtcagaagctgccagagtgagtggctcagcaacttgctccatgagggacccccaactgcatgcatctgagtagaaatacagcacctgtggcccgtcccccgcccaacccacatttctacaggatcctgggtgcctgggcggttcacctgggcttgaggggctgccagggactcagctccaccccgtccctctctgagtctccccattcggtgtctggctgtccccctacagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcaggtacacccgtattctgtctgtctgccgcgggcccgaaagggtgctggtagtcctccgccacagggcacctccctggtcccaaccagatggccactgaggggttttacttcccttctgcagggcagtagggcagctgagccgccccatcccggcaaggagggtgcttcgttcacttgctgtcccttcccctccctccctgtcctttcattccccacatgtgccctcccccacctctcctcttcccttctctctcccctctccttcgacacttcccctctctcctcttccccctctctctccccctcacccttgccccctctgtccctgcatcttccggccccctcctcctcctggcccctcctcctcccttcctccttttccttcctctctcttcctccttcccctgtccccctcaccttccctccctcacctctccttctgtgcttgcccccttccctccctccctccctcctccctgtctcctgggaggctcctttaccccgcctccccctccttctgctctccctcctgctgtgggggttgacagaacactgcatgtctgtccttcctccggcaatttcatcttcttgagcacagggactgcatcgcagttacctctcagcccttctccagggcgtcctaacatgacacactcccagggacagtgccccggcacgcacagagattgtcacacgtgtttgtccacagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccaggtatttgcccgagggagggcaccgactcttcccgctccctctgcccaggtcccagtccccagacaggtccaatcaggacctcagttcctgccgccctggaacatctgcatagttacggtgatcactgtaaatgtttccctaacgtccttcccttccccaacaaaacaaaagaaaatacaaagaaaaaaagctctgccgaaacatgaatttgcagataccgcagtgattccaggcactggtggggcggtgctgccccctggtgaaaaccagccagattgtagcagaaagcccgaagcaccttctctggcctctcatgatccggttttgagtcctggagttaatccccagctgtaggacacgctagagctgccctcagaagctgggagaacagccaccttggggagggtggttatgggtgaaaataactgattttgaactagggcacaggactggcaaaccgattcccctccattatttcagtttatttattattgttttttaatcttttttttttttttttttagacagtctcactctgtcgcccaggctggagtgcagcggtgtgatcttggctcactgcaacctccgcctcctaggttcaagtgattctcccgcctcagcctttccagtagctgggattacacagcgcctgccaccacacccagctaatttctgtatttttagtagagatggggtttcgccttgttggccaggctggtcttgaactcctgacctcaggtgatctgcctgcctaggcttcccaaagtgctgggattacaggtgtgagccaccgtgcccggcccccctcccttatttcagatggaaaagggccttttaggaagaggccgctgctccgctctgaactatgtctatggccttgatgggggctcttacaaggggttaaacaggaagccattcacagaggggcttagctgtacacccaccagggagaaggggccaggaccctgacaggaaggttatggagggaacaaacagagaccccttctcacctgggagttccacaagtttcttagcaaatggaccatcttgtttcccccagtgtgttctgaactctcgctctctcaatctgactcaatgaaaatgatttgtgtgtgttttcagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaagtgctccatctggccctagggaacacaccagatcttggaattcagttaccacctcctcccatagcccccatctcttcttaactgtatacacctgaatcccaagcttcagcagctcctcctaaacaatgaagtccaggaaatggcatctgggtgaactggctgattgcatgcggcccccaagaggatgagtgtaggttgccgtgattctccgtgcaatgcactggaaatctggatttttgtgattttagtttattttattattttttttttttttaggtaaataaaattttgaggaaccacttaattaggccccactggatgttcgcgatggacaacatcatccgccgagcggtgcaggccgcggtcaccattctcatcccaggtgagcgccccctttgtggtcaaggtcagctttaggccgtgaaaagataagaaatatcctcttcattcaacagttgttgcttttctcttttccatcttggttatctacttccttggaattaaatgcatgttgtcatagacttcttccggggctgattctgtagttctgagagcatctcgtggtgctgtatttacgtgtccctgaagcatgatgaaggtgactacacataaactataactcacaatctcaaaagggagcatggggccggacgcggtggctcatgcctgtaatcccagcactttgggaggacgaggtgggcagatcagctgaggtcaggagttcaagaccaggctggccaacatagtgaaaccccgtctctactaaaaatacaaaaaattagccaggcttggtggcacgtgcctgtaatcccagctactcgggaggctgaggcaggaaaatcgcttgaacccgggtggtggaggttgcagtgagccgagatcacgccactgcactccagcctgggcaacagagtgagattccgtctcaataaaaataaacaaatacataaataatattaaattaaaagggagcatggggccagaggggaaggatcctccagtcctctggtatccccttcatcgtgcactcaggaatgtttcttgggtaactgacaatacagtggctcagattcctctctctgaatcatcatgtagtagttacagaagtttttggtttttgtcaatttcctttttgaaatgttaccaaagttgattctccttctctggtgacttcttcctgctaagggaggctttacagcccattctgtcgccatcatggtttccccctttccttcagctccttgctgtttggctccagcccaccctcccgaatgcactgtgtagcccaggctcagctgcaggagaggcttgggaaaccccagtgcttaattcctctcccactccaagcagacaccttctgtagtaaaacggcacaggcttgggtggcagcctggctctacttatttctttcttttctttttttttttttctgagacagagtcttgctctgtcacccaggctggagtgcaatgatgcgatctcgcctcactgcaacctccatctcccaggttcaagcaattctcctgcctcagcctccggagtagctggggctacaggtgcgcgccaccacacccagctaattttttttagtagagacggggtttcaccatgttggccaggatggtcttgatctcttgaccttgtgatctgcccgcctcagcctcccaaagtgatgggattacaggcgtgagccactgcgcctggacctggctaatttttgtatatattttttagtagagatggggtttcaccatgttggccgggctggtttcaaactcctgacctcaagtgatctgcctgcctcagcctcccaaagtgcttggattacaggtgtaagccattgctcctggcctggttgtaccttttgaacgctggccttggttcacttcatatccttaagcctcaatttcttcctgtggaaactggcgtgatcaactttacgctgcagagaaccaaatggaacagtctcttctccatttgtaaagtcagcagtcccctaatggagcatggcacgggctgggccagcttctgaacagcccggtttgctgacctgggtgtctgcgaccccaggccccactggcctggtttgctcaccattgtcatgtcttgtgtgatttgcagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacaggtgaggagcttctgggccctcctctgggagcaggcgctgggacagtggcctgagccaccaagatgctgattaattggctttattgttgaccatctcacccaggtcttaggaaaaagcagcttcatcatccacgaactaggcaagggcgcatattctcagcctcaattgagggactagaggaatgccttcctttaaaaaaaaaaaaaaaaaaactcagaatcagagaggtatatatagtaccttgccccagaccacacagaaattactcatactaaaggcagcagcatctgtgaattctttctctcttttcaccaagacggggcccctggcatggtgtgtgggtctcgcaggctcagcagcctgcccctgcagaagtagcagggtttgggggttggttagcacttcatcagtggatgtacatcccataatcccgaccccgaggaagtttgtcctgttgtcatttcttccatgtgatttgtcatgatccctagacgggcattagtggactagcttcccaaccagggaaccctggcatcaccatcatattcctccaatgcactggtctgttttgttcacttcctggcacatagtaggtgcttaatatttgtgaagtggatgggcgtggtggctcacgcctgtaatcccaacactttgagaggccgaggtgagtggatcacttaaggtcaagagtttgagacagcctggccaacatggtgaaaccccatctcttctaaaactacaaaattagccaggtatggtggcgcacgcctgtaatcttagctgcttgggaagctgaggcaggagaatcgattgaatccgggaggtgggggttgcagtgagctgagatcgtgccattgcactctagcctgggcaatgagagaaactccatctgaaaaaaagaaaaaaaggggaagaaatatttgtgaaatgaataaaattattcctgtttgctctgggaagtcacattatcagctgcgtgatttggtttttaaaagtaatccatagttgaccgggcacagtggctcacacctgtaatcccagcactttgggaggccaagatgggtggatcataaggttaggggttcgagaccagcctggccaatatggtgaaaccccgtctctactaaaaatacaaaaattagctgggcgtggtggaacttgcctgtaatcccagctactcaggaggctgaggcagaagaattgcttgaacccgggaggcggaggttgcagtgagccgagatcgtgccactgcactccagcctgggcgacagcatgagactctgtctcaaaaaaaaaaaaaaaaaaaaaaaaaaaaaaaaaaaaaaaaaaatccatagttatagcaaatgagttggtactcattccaaatgacactttgttgctgtgggatcattgctgaggaatgctaatgactatttaaccgggagacaaggggccagttacgtattttggatgaaaggttgtgtatgctgtcagggatctctcaagttcaatcttagatcatctaatcatttctttttttaaaagacccagagctttagttaaatggtagtggtggcaacattttgaaagtttttttttttttttaagttcaagagtacaagtgcaggttttttacacaggtaaacttgtgtcatgggggtttattgtacagattgtttcatcacccaggcattaagcctagtatccattagttgcttttcctgatcctcctcccagcctccaccctctggtaggccccagtgtgtgttgttcccctctatgtgtccatatgttctcatcatttagctcccacggcacgtggtatttggttttttgttcctgcatttgtttgctaaggataatggcctccggctccattcatgtccctgcaaaggacatgatctcgttctttttttatggctgcataatattccatggtgtatatgtaccacattttctttagtctatcatcaatggacatttaggatgattccatgtctttgctattgtgaatagtgctgcaatgaacatatatgtgcatgtatctttataatagaaccatttatattcctctgggcatatacccagtaatgaggttgctgggtcacccaataagatttataatcaccaaattcataaaatgattatatatgggtttgaaggttatttctctccactgtcgatagtcattgtgttattttccagtctcagtggaatgaggaattggttaggcagcagccagtctgtgaatggcattgacgtaaactgtacattcctgcataaggtgcttgtccttgtgtgtattagtccattttcacgctgctgatacataccagaaactgggcaatttataagagtaagaggtttaatggacttacagttccacgaggctggggaggcctcacaatcatggcagaaggtaaaaggcacgtcttacatggcagcagacaagaaagaatgaaagaaccaggcggaaggggttttcccttataaagccatcagatctcatgagacttattcagtaccatgagaacagtatgggggaaaccacccccatgattcaattatctcccactgggtccctcccacaacacaagggaattatgggagctacagttcaagatgagatttgggtggggacacagccaaaccatatcactgtagtatgaagtgccttggctatgtggcagttgggcagagccaaaggaagatgacacctcttagacaggatgatgtgtctgtcctgatgaagtcctgagagtccttcccactggatacaggcacaagcttgagttgtctccttcactaacgtaaaaggaggactactagagagaccaggatgaaggcaggcagttgggcagggctgggagaggacttctaatttgctgagtgccaatatttcctctgctgttgtgctggggcagaagtgttctcctctccccaccccactttgccaccaaataatccaggagttcctgtgttctcatctctctactgttgcagtgacttctcatggcaacttcaataattaccttcagtctttttttttttttttttttttttttgagatggaggctcgctctatcatccaggctggagtgcagtggcacattcttggctcactgcaaccttcacctcccgggttcaagcgattctcctgcctcagcctcccgagtacctgggaccacaggtgcacaccaccacacccagctaatttttgtatttttagtagagatggggtttcaccatattggccaggccggtctcaaactcctgacctcaggtgatccacctgccttggcctcccaaagttctgggatgacaggtgtgagccaccacccccagcagccttcagtaatttcaataaagcttagttctgtattcccaagttcaccagcatggatcatataaatgaattaaaggaacacacagttaagaaacaaatcccatgtactaggtatgtaagcaaacaataaaagtgtgggggccaaggcccttggcccctggaggtttgctgaaaatcacctgcatgaggctgattaatgagagaaaaggcatgcaaatgtatttaacatgtatttaacttcagcatgaagacccaaagatccaggggaaattgtccatttttatgcttaggcttaacaaagtatggagagctgtggagaaacagggataaaaagggcctgatcgaatgctgatagactgagtggggaaacccagcaaggcctgtctgtctagatccttcttggcctctctgagtagcattcctttctcctgggtgtggggcaggaccctctggaatcgggggtcttatgaactacagtcaaacaaagtaggtcgaagaactttttttttttttttttgagatggagtttgactctgttgcccaggctagagtgcagtggtgcaatctctgctcactgcaacctctgcctcctgggttcgaactattcttctgcctcagtctcccctcccgagtagctgggattacaggcgcacgccaccacaactggctgatttttgtatttttagtagagacggggtttcaccatattggccaggctggtcttgaactcctgacctcaggtgatcctcccgccttgacctcccaaagtgctgggattataggcttgagccactgcgcccagcccaaagaatttttttttttttttttttttgagacagagtttcgctcttgttgcccaggctggagtacaatggtgccatcttggctcaccgcaacctctgcctcccaggttaaagcgattctcctgcctcagcctcccaagtaactcggattacaggcatgtgccaccacgcctggctaattttgtatttttagtagagaggcttctccatgttaggctggtctcaaacttctgacctcaggtgatctgcctacctcagcctcccaaagtgctgggattacaggcttgagctgccgcacccggccaagaatttctttataaccaatttttacacagaaaggcggagggaaagttagagtcgtatttttaggttttgtggctggctttggggaggagttctggtttctgtgccccgctttggggaagagggattctatggtgcctccaggagaatggactgagagagggaggcaggagaaggtcagaggaaaactttttcttctgaggctgctgctgaggccatttgggggcactgttttctgagccccaacaaaagctagacgtggttccaatctgtcagccctttcccccaaggcatgctatgcctgagctggcatgtgggggaagtttgaggcacagttgtgccaagtcatatctgatcccagagagcccatgagcaagactgggtttcaggaggcggtcccttgggaagagcccagcctgtggactctgggcgttacttaactcctctgcctcagttacctcagcttcaaaacaggggtttagaacaaccagtgcttcctagaagtgccgcagggcttcagtgactgaattcatgcagtgtttggcacagtcctggattctgggtaggaagtgcttggtggatgttggcaggagccatcctccccaccggcagagcagcatgtctcactcactgtccctgctctgccccattacaagcaggggcttccagctgggtgcggtggctcacacctgtaatcccagcactttgggaggccgaggcaggtggatcacttgaggtcaggagttcgagaccagcctggccaatatggtgtaaccctgtctctactaaaaatacaaaaattacccatgcatggtggcgcatgcctgtagtcccagatactcgggaggctgaggcaggagaattgcctgaacccaggaggcggaggttgcagtgagccgagattgtgccactgcactccagcctgggccacagagtgagactctgtctccaaaaaaaaaaaaacaaaaacaaaataagaagcaggggcttctgtccccttcgtttagtccctgtgtgaggaggaaagaaacttaccattctattctagtttcagctgccttatctgacttagggagccaggtttaaataatcacatcgtccttctggctgagttctgattaacatcggcatcttttggttcacgatacgtttttgagacaaaactgcctgagtgcgttcaggctactgtaacaaaataaccagagaccaggcagcttataaacaacagaaatgtgtttctcacagttctggagactcgaagtccaagatcgaggtgccagcagattccgtggccagtgagggcctgcttccccattcacagatggccatcttctcgcggtgtgtcctcacatggtggaagggatgagggagcctctggggtctcctttcacaaggacactcctctcacctcacctctcaaagctccgtctcctaacaccatcaccttgtgggttaggatttcaacatatgaacttgggccgggtgaggggcacacattgagtccattgcaaaaatatatccaagctgtgagcactggcctttgttgtcaaggggaggaaaacacaaggaaggttcccctctgcagactgaagtctgagtcacagaacctgaagaaacacatgtgcttccctctctaggctgactcttagacttgtcccattttccattttttttccatctctaatgtatgcacaacagatgcttgagttaaattgaatggtgttgaatgctctctggataatggctttttttttttttttttaaaccagacttttggaacacctagttgaaaaagagagagagtaccagaatcttctgcggcaaactctagaacagaaaactcaagaattgtatcaccttcagttaaaattaaaatcgaattgtaagtcattttccaatgagacagactttaacatctagctaatattctagttagctttgaagaaacatttgaggttatcttctgttaatccaggactccagtagattctagactacttctcaatcataaaaagggactactgatagattcaacaacatggctgcattgtaaatgcagtatgctaagtgaaagagctagattcacagccagcaccgtagctcgtgcctgtaatcccagcactctgggaggctgaggctagcagatcaattgaacccaggagttcaggaccagcctggtcaacatggcaaaaccccatccgtacaaaaaatagaaaaaaaccagctgggcttggtggatgcatgcctgtagtcctagctacttaggaggctgacatgggaggatcacctgagcccaggaggttgaggctgcagtgagccgaggtcatgccactgcactctggcctgagtgacagtgaaaccctgtctcaaaaaaaaaaaaaaaaaaaaagattcaaaaggccacataccatgattccttttcctccagaaaaggcaaaactacagggacagaatcagaatggggaggtgacgggactgattgtaaagggcacatgaggacttttgggagtgacagtcatttctgtatctgtgctgccaccttcatagcacattggacacctaaaaagggtagtttactgcataagtaaataaatatgcctccatcaacctgacattcgttttgggccacttagaaacgagctccagagctacctcttggaatgtggactagataagctctgacctcaacactaaaacctatttccttgtaggatttccagtgcagttagggatgtgattcctaaggaaaggcatttgaaagatgtggggataagcatttaaagtggtagacctaacatgtcaaattccaaactaactgaaggtatcctagatgaggaggctttctagaaagtgaatctcagaattatgaattgtgtaatacgtattagcgtggttcagtgatacagggttaattcatctctttttcacatcacatttacattctggaatcatttattaatccaactggttacttttgaagagttttatggttagactaatatataacaaattgccaatcgttacaggtattacagagaacccagcaggcccctacgggcagagaacagataaagagcttatagactggttgcggctgcaaggagctgatgcaaagacaattgaaaaggtaaatttacaacaaagaaattcttatgctgttgttacacagctgctcagctcttaaggatctgatctttgtttcagattgttgaagagggttatacactttcggatattcttaatgagatcactaaggaagatctaagataccttcgactacggtaagagcctcaaaacagtttgtataagagaatacaactttttatgtgtgaatatgcttcaagagcagaaaacaaagggctgggcctccccccaaactctggagttctattaggttcaagctgggaaaaagccaaggtggggcagaaactgaaagccaggcagaagtcagaaataggaatgtgacagagaagagctggccaatctcctgccattaatgcctggctgggagtgggtggaggcacatggcaagcgtgcctgcacgctggacccacccccttctttaaactgcagcctgccttcttgttcccgagtcatttgaaatagccagctctctgcaggtacgtacctctaaggccatgtcctactactgctgggacacgagcgtcacctccatatgtgaggagaatgtttttattttcattaggtttttaaattagggactgcagttttaagctctgttggcttgaagcactgactctgaagacagctgtgtttgtttcccaggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttgtaga

SEQ ID NO: 3205 - DNA, 100069 bp, human
atgacatccggaaagccagagagaaataccaaggtgaggaactggcgaaggagctagctcggatcaagctccgcatggataatactgaggttctgacctcagacatcatcattaacttactcctgtcctaccgtgatatccaggtatgaaatccacctagccgaggctcacgtatgctacgttcttccttggcttgaggaacgtcttgtgaagtatttgtatactcagtatgtggtgaagtggctgggttttgttcttcttttttgttttcttttttgagatggagttttgctcttgttgcccaggctggagtgcaatggtgcgatctcggctcactgcaacctcagcctcccgggttcaagctgttctcctgcctcagcctcctgagtagctgtgattacaggcatgcgccaccatgcccagataactttatatttttagtagagacagggttttcaccatgttggtcaggctggtcttaaactcctgacctcaggtgatccacccgcctcggcctcccaaagtgctgggattgcaggcatgagccactgtgcccggccagaggtggccgttttatagacaaatggtatgtggctaggtcataggtcatccagcttatctgttgtggtggaaattttggagaaggttttgtcacatcggggctggtgtgaccactccgacaagaagagatgtcataaacaggactgtttggcagaaggagccaagaatttaagtttatatgaactttacactaggcattgtaccaagccctttgacaaacctgaattcatttaatcctcttaacaaccctatgtgggatatgtgtactctgattatccacattttacacatgaggaaactgaggcacagagcggttaagtaacttgcccgaggtcacacagcagttggttaggtcaggattcagactgagactgatgctccgttgtccttgttcctaacccctctgctgtgcaacttcctttaggcttttgtcacttcctcctttgtttaccaccatacatcagtgacagggagaacaggagtagcagaaacacattcaggacccagggaatgtagatgtttattctgagacaagcatcagaagctactggagagttctgagactggtcttttggtctgtggttccgtgaaggaaattgagcgtttcctctctccaagttgaatgccattgagccatctctaaggatgtcttggcttcctttcctttggaggaacacaggatcacgtaccttactcatagaattccacaaagccatgttgagagttgttggctagaagtctttaaattgaagtgatggaggcgtccacttatgacctggaccaaaacagagtcaaccagtaaggaactcctgcccctggtgataaacagatgcagctagctgattttatttctgtttttcaaatttttatttatttatttatttattgagacacagtcttgctctgttacccaggctggagtgcagtggtgtgatctcagctcactgcaacctccgactcccaggttcaagcagttctcctgcctcagccttcccagtagctggaattacaggtgcctgccaccttgcctggctaacttttttaatttttagtagggatggggtttcaccatgttgggcaggctgatctcaaactcctgacctcaggtgatccatctgccttggcctcccagagtgctgggattacaggcgtgagccaccgtgcctggccagctagctgattttaatagcagttgctactagggatgataatgattaggtcttgtctcccaggacaagaacatgggaatgacttttcttgaagcctttcttccctcgagctgctgctttttgtccttcccttcatgtatcccttcttttcataaccttccattcatgctcaaaggtgggccaagaggttcttggaataccctgccttctccctcctggggcagcagcatcaaggcgcagagccacaggacaggcatggcatttcagtgggaagccctgttctgctgaccatggctggctgtcagcaagttggccagttccaacgattctaagcctggctgaaagagtaacaggcggcactgctaagaggggacttggctgagacaagcatggtcgcaatttttctccaggtaattatgcagagtttagagcagtggttctcaacccaaggacttttttggcagtgtctggagacattttcagttgtaaaaactaagtgcgtgtgtggggcatgaggtgggtggtgtgctgtggcttccagtgggtcaaggccagcatcctacagtgcccaggacagctcccacaacagagaattatggtccagaaacgtcactagtcccaaggttgagaaacactagtttagattaatgtatttgattctggcaaaataggaaagactggaatctatgtgctttgactggaagtttgcttgtgtgtatttgtccagctcactttaacacacatctctgctgatactgtttttttattttgtttttgattttgagacagacggagtcttgctctgttgcccagcctggaatgcagtggcacaatcttggctcactgcaacctccgcctctcaggttcaatcaattctcctgcctcagcctctcgagtagctgggattccaggcgcccgccaccatgcccagctatattttgtatttttagtagagacagggtttcaccatgttggccaggctagtctcgaactcctgacttcaagtgatccacccacctccgcctctcaaagtgctgagattacaggtgtgagccaccacgcccagcctctgctgatgttgttaactctcctacactcagctgtttcctggctgctggcctcatttacttttgttgcctttggatgcttcatgccctttgatagcagggattccttctctgttcttctctctctcatccatcttattttctggtctttttccctcctattaaaggctacaagtaacttcactaaatgccctttgtaaggaagggcctgtctttaagtgcggaggctgtctcctgtttataacaattcagaaaaatcagtgaagagctgtgtttcctctcttgctcactttgggacctcttgccaacaggactatgatgcgatggtgaagctggtggaaacactggagatgctgcctacgtgtgatttggccgatcagcataacattaaattccactatgcgtttgcactgaataggtaagaacgataatgtacgtacaggttttgaaacatgccacccattgaattgtgcttccttctttcattcaacatcgggtatgagccaggtcacgtgctaaatgccaaggttatgaagatggacaaggtccagtctttgtcctcagggactttgtatttggcatacacattctagctgtgagattgaacacatcaatccatcctaatagcttatgacggcatcaaaacaggcacccccggcttcacatatcttgtaacacatacgaggtcacatctcttttttaaatcggtaaaatttgcagtcagtgaaatgcacagatcttaagtatatgatttgtgtttgataattggctatacacatggaaacaacactcccatcaaaaaagaaaacatttccatcaccccagaagttcccttgtgctcctttgcaggcaatccttaacccctccataggtgaccactgttacagcctctgtctccatagatgagtttggcttgtccttgacttcacataaacggaatcacacagtgtgtactcttttgtgtcattcatcgtcgtgttcgcgagattcatctatgcggttgtgtgtattagtggtttgttcgttctcattgccgtcgcgtagtccttggtataggtatgccacaatcatctgttttactgctgatgggcctctaggttgtttgcggtttggggatactgagaacagcgctgctatggacattgctgtacatgctttttctacacatatggatacatttctcgggtatatagcatgtgcttgtagtagacatcggcaaacagtggtaggattctgattcctttttgggagaaagcttcatggtctctgtggaaatgcacctgctctctccccagcagcctttaaacccagcatcccaaggatgcattgttgtgaatgacggccagtcttcattaagcctgataaagtcttgtaactttgttcccccgacatagtaagctccattcttatttatatttacctgtgcttgattaataaccattaaatgagccatcacgcctgaggttcttgggagagtgcctggcacactgtaagtgctgtaaaaaattggtttgttaaataaaaactataagggccttttaagttactcatcactaagtctttttcccagacatagtagaggtaaccgttgtcagacagagaatgaaataatagattgccattttctcaaaataacaaaagagtaaaacaagatttgaaatggaaaattggggccggccgcagtggctcatgcttgtaatcccagcactttgggaggccgaggcgggcagatcacttgagctcaggagttcaagaccagcctgggcaacatggcaaaaccccgtctctacaaaaaaaaaaaaaaaaaaaaaaaaaaattagccaggcatgatggcttgtgcttgtagtctctcagctactcaggaggctaaggtaggcggcttgcttgatcctgggaagttgatgctgtagtgagccatgattgcaccattgcactccagcctgggtggcagaatggagaccctgtttcaaaaaaaaaaaaaagaaaaaagaaaaaaagacatagaaaattggtatttaggagaaacaggtatagcaggatgaggtgatcctgagatgaatacgtttcccgtttggaagcagaatggctgggattgcacaccagatagccacctttctctttgatgggtcttttccttctagtctgattatctcctgttagacagtggctctgtttaatagggccagacggggtctccaacactgagaacctcattttctccaacaaactaaggattttctatgggattgcaatacttgcttcatttacacatgtaatctgatcctgaatttcacatttttgctttaggcttaagttggccagccgtcaacatagtaggagtttgcattacacattgagcatctctaatctgaaaatctgaattgaaaagtgctcctaaatccaaaactttttgagcgccaacatgatgctcaaaggaaatgctcattggagcattttgtatttcaaattagggatgcttaactcgtaagtataatgtaaacattccaaaatctgaaatactgcaaatccaaagcacttctggtcccgagcattttggataagagatacctaactggtatatatagttttgagcgagtttatggcattactttgtatctgtaaaggggaaaatagtgatggacaagaaatgagttttcctgcatgaaggttgacctttagctctcaggaagtggagcaaatcatggccagaaatgagttactgaaggttggcagtaatggatgactttcgaccctcagatgtcaagggctccctgttagtgggaaagctggctcgagccggtcagctttccctgataccttccactccactgcgttcagaagcccattcaaagctacttcaagtttccactgagcagttaaactgcttgctgcttgatggcatggaatattttatgagtgatttgtatttgctgttgcttttacaaatggggctttattagatatatgaatgtagtcagaatattctgaccagggatccagccagtgagctggatggtctagaagaagaaaatcagaatcaaagtcccaggttcaaaacaaaatagaacttgccagtcgcaaaatagaaggcatgtgctcatattctacttccagcatctttggatcgagactaccaactctggcaaaatttacctctttgaattactcagcaagtggcagggcagttggatgtgtgacgcactgactggaatgtctaatatgtcgttctgtaaataaggggagtgctagatgagaatgctctgcagaccctagaaatgtgtgcaggggacatgagatgaacgtgactgaatccagcccacaccagaggggctgcatgcttgttccagaacctactgtattcacctgagccttagtctctgagcttcccagccgagagggcagagtgagctcgtcatctctacagtagccacgagcctccttttgtctcttctgttgatgttcgctgtttgatttcgctgtcttaatttccatgtggatataagtagcattctttatgacatgtttgtcaaatgtagaaaaatgatgacatcttcccacttttctaatgcattgtctccaggctcctaaaagcatcttgtgaaagaaggatacatacttgttgcttttctagtgaagagaaccacaaaatctgccaacttaaaaggaatcatttagtccaaatcctttgttttggagaggagaaagaaacaaacaaagaaaaaggcaagggcccaaaatgtaacacttggtcaataagagatctggaaccagaactccctccctaatgttaccacagcacactgcatatactacttttttttttttttttggcctgagacgctcactctgtcgcccaggctggagtgcaatggcgtaatcttggctcactgcaaccttcgcctcccgggttcaagcgattctgctgccttagccccctgagtagctgggattacaggtgcgcatcaccacgcctggctaatatttgtattttagtagagacgaggtttcaccgtgttggccaggctggtctcaaactcctgacctcaagtaatccacccgcctcagcctcccaaagtgctgggattacagacatgagccactgtgcccggccttggtttggtgtttattgtagcaaaaaaatacatataaaatttaccatcttaaccacttttaagcatatagttcagtactgttaaatatgttcacatatggtgaaacggggctctagaagttttcattttgtaaatctgaaactatgcacacattcattaaacagctgcccgttgctcccttccccagtccctagcaaccaccattcttctgtttctgtgactgtgactatcccaggtacctcatataagtgaaatcgtacagcactactgtccaatcttttggcttccctgggccacattggaagaagaattgtcttggaccatacataaaatacactaaccattgctgatgagctaaaaaaaaaaaaattgcaagaaaacctcataatgttttaagaaagtttacgcattggtattgggctgcattcaaagccatcatggaccatatgggccgctggttgaacaaccttgtacagggtttgtctttctctgactgctttatttcacttagtgtaatgtcctcaaggttcattcatggttgtagcatgtgtcagaacttccttttcaagggtgaataatccattgtatgtacagaccacattttgtttatccattcatctgtcgatggacatttaggttacctcttgagtattgtggatagtgctactattaacatagtgtgcaaatatttcttctagaccctgcttccaattcttttggatatatgcccagaagtaaaattgttggatcatatggtagtcctatttttaatttttttctttttctttttctttcttcttttcttttcttttcttttcttttcttttctcttttcttttctctcttctcttctcttctcttctctttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctctgacagaatcctgctctgtcacccaggctggagtgcagtggcatgatcttggctcactgcaacctccacctcccaggttcaagtgattctcctgcttcagccacctgagtagctgggactacaggtgcacaccaccacacctggcgaatgttttttggtagagatgggattttgccatgtttcctaggctggtctagaacccctgacctcaagtgatccacctatctcaacctcccaaagtgctgagattacaggcatgaaccaccatgcctggcatatttttaattttttgaggaatctgtaaattgttttccatcgtgcctgccccatttacatctcaccagcggtgtacagtttctccaatccttgccaacacttattttctgttttcctttttttttttattagctgccctaatgcgtataagatgatagcctattgtagtttcaatggacgtttctctgattagtgacactgagcatcttttcatctgcttgttggccatttgtatattatctttggagaaatgtctattcaagttctttgcccaattttttaaaaggttatttgatttttgttgttgttgagttgtaggagggtttttttttttatatatatatattctggctattgactcccgatcaaatatacaatttgtaactgttttcctatattgtataggttgacttttcactctgttgattgtatcctttgatgcccaaaagtttttaagtttgatgtctcatttatctgatcttcttcttttttttttttttttggaaactgactctgttgcccaggctggagtgcagtggtgtgacttccgctcaaggcagcctccacctcccgggttcaagcaattctcctgcctcagcctcccgagtagctgggattaccggcacccaccaccacgccagctaatttttgtatttttagtagagatggggtttcgccctgttggcaaggctggtctcgaactcctgacctcaagtaatccacctgcctcggcttcccaaagtgccagggttacaggcgtgagccactgcacccggccggatgtctcatttatctaatcctgctttgttgcctgtgctttcaatgtcatacccatgaaatccttgccacatgtatactttttataacaaaaagccagttgtattttttttttttgataaatgaaccatcttatcttctgagcagtggccttgccaataatacatgttatcttttaaaaaaatatttgcttaaagggctctgtcttcattgctcctcactggcctccttgagcccgtgatatcttccttttctgtttccttcttcagttccctcctttttgtccttcctcctttatttactaacttatttatgtgtcagtagaagggctgtgtgtaaaggaagagggttcatgaggggtgactgaagttaacaggtgattttttaaaaaatcacgttttcaagtccaacagagcttaaaggtaaaataaaaataaaaaattacacgtgtatatttctctctcacacacacctgaacttatacaaacaagtgaatttgtttgattcaaatgaatttcactgcagtgttctgcattgattttggcaatgctgcctttattcagaatattatggcatcagtcagagaggaatttttttctttggaattgccagctttctttatttttttcgtctcctctcccttttctcctgtcctcttctcctcctctcctctgttgtccaggctagagtgcagtggtgtgatgatggctcattgcaaccttgactttctgggctcaagtgatcctcccacctcagcctcctaagtaggcacatgccaccatgcccagctaatttggaattgctagctttcaaggcacataggaaatcaatatcattccaatgggttctgaagacagatttgggttccagttcctgcttctgtactttattgttatggccgtggtcaagtaatttaacctcctcaaacgttggtgtccccatttataaaatgtgatactgacatctaccatgtagtatcacttggagtactcctggcacgaagcaggtgcttggctattgctcttactattactgtgtagcttgatcacccatattttttctaccaggtttgagggataacttttgaccatttccaaataccaaaactactagcaaaatacagagattgccaccacagacaatatttaaaataacatacctttggctctgaaaaaaaattcttaagagaaatttatagaagtgcttttagcaccagaacatcgttctaataagtctctggccctctgagatgactattttgcgtgggacagggttgatctgaatataggtatttgcagaaaaaagcgatcgtttggtaaattcaaagtttattgatttagagtgggtttcttcaccttggcactattgatatttggagctggataactctctgtcatgggggctgtcctatgtatagtaagatgtttagcaacatccctcgtctttacccactagatgccaataccactccccccgcacctcacccaatgtaacaaccaaaaatgtctctagacattgataaatgtcccataggggacaaaaatcccttctggttgagaccactgatttacagggaggcatttgaggtatagaaaaagtgcacgctttgacatttgcatcaccaacaatatgatgttgtcaagctaattaaactccttcagcctgaatttgttcatctgtaaaccaggatggtgatgcctaaataagatatgccatatgcaaatgactgcacggcccctggcagctagaaggcagttcataaaagtttgatagctcctccatttatccctcatttacacttcttaattctaatcgggagataacctagtgttacataaaaagattacagagtcaacagggcgagtgccaagtggcttagtctgtaggaattatggttgcttaaagtagacaagaaaaactgcttgtaatgtggccaaaaagtggcccagagctcttaactggctgttggtcacccagagagcattcaacttggggaatggtttgagaaatactccaaaactgctctactgtttacaacccacaaaactgtggactggactgctgggaaaaaaaagtagaatggtgggaattaatttgaggctttaaaaattaaataatatcataagtaaaatattagcatagtgtctggtgcctagataatgttggatgaatgttaattgcccttctatttcccaccagagaattccaaccaccagtgttaggtcatctccaatgatagtctgaactgaaaacaatgttatgaccaagttttctatcagcctaagaaaatgcaacactgagagagctaagactaatgaatacaatgcgtaaaggactttaaaataaaatttttccatacctgacatcaaattttttcatcaatgagatttaagaacacagttccttatgtttttctcatgtataattttttttcggggacagggggggaccttcctccagtggtttaaggtattttttcccccataacagtaaagtcaaatacaggagacattgttttaacatatctttgtgactgggcatccagaaaattggttaacactgttaacagccctgccaattgctcacttgattgttttgaggctcatggtagcatgtattgcagttaccagcctcagatatcagttgaggacataaggactgggaatttatttgtaatacattttgacatgcagggtaaaccgttaattattaaccattcctgaggaaaatcctgacccatgtaagttgctaccagggcctccgcttggcactctgaatcaatcgcatgtggacattccctgttagctgcattgtgaagtcctcgttgccacgttgagtcaggaagaccaaactggaagttcaggagacactaaccctggaaaagctgccttctcgcccgctgcctgaggatttcaaacaaatgagaaaagccacagttccacttaggaaacattgactttcctgtagattcagcctcctacaccttagagcgggtgttgagagacttcacatgcgttcatccctgtcgctgttgtccttgagataaggacattgataaagagaaggtgggagacatcctttcagattttcgtgggtttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgcttttagccgggatggtctccatctcctgacctcgtgatctgcctgcctcggcctcccaaagtgctgggattacaggcgtgagccaccgcgcccggcctcgtgggtgagtttctaaagagacagaagggccactaaatcaaccctgtataacccccttctaaattcaggatggcaattcacattttactttagatgaaatattatcagtaagtgagtttggataatgcttcacttaagattcagaacagttgtgtttcagtgtgtttgaacactttgtagtatatcacagctcttatttcagcaatgtagggaggatacgtttatgcctgtgttgaaggacttgtaaagaaaggactttgtgttgtaggaaaagtgttggtttgagatttaggcagcctgtattctatcccagttctcctcctaactagctgggtatctgtgggcaagtcactttacttcccaggaattagtagaagtggacatacagaagacaagaaataaaaagggccaagcacagtggcttgcacctgtaatcccagcaactcctgaggtcaggagtctgagaccagcctgagcaacatagcaagaccccgtctctacaaaacaaaatttaaaaattagccggtgtggtggtgtacaactatagtcccagctactcaggagactgaggcaggagtagcgcatgagcccaggaggtcaaggctgcagtgagctatgattgtaccactgcgttccagcctgggccacagagccaggccctgtctcaatcaataaatcattaagtttaaaaaataaattacctaattaatttttaaaatatataaataaataatttttttaaaaaaaggaagggaaggctgtaggctgggtaccagttccagttgaggttgtctctttagttgtactccaggtgccagattacaagttcacccgatgccaccccgtgtatttcagtggttgatgtttgataagaccggaggttaagatgggctctgactacagtgaacagtccagtttagcctgactgaagggtttatttaggtgatagggagaaatagatggctgaggagggaggttggccccaggggttaaggaccttgactgataagctaaggaatttgaattttgttctgtagtccctagggagtaattactgaaggttttgtaaactggactgacatgagccaggttacgactccaccactatctgcatggccttaggcaggtcaccaaactttcctagacctagaccttatagtcatcttttttaaagagagagagagagagtgatttggaccagatgattttgaatattgctctcctttcaaaagttctgagtctataacttgaagcatcattttattagttgaatgattagagacagatcctttaagaccttgctttatgatggattctttatcctatcagcgatctatctcagtcctatttgttgttgtaaactcaattacgtcaccgttcccagggagaggaaaacctactctgtgtgctttctcactttgcttcctagtaacacgttataataacggagtttttccttaaacaataaaagattttgttagaacgcaggttaagtgaactaaaaggcacacatacagtttatttcacggccaaatgccaaattttcctcaaattatttgcccactacctcagctagtctctgtctagttttgttgctgttgctggctgattaatatttatttatttatttatttatttatttattgatttttgagatggagtttcgctcttgtcgcccaggctgcagtacaatggcatgatctcagctcactgcaatctctgcctcccgggttcgagcagttctcctgcttcagcctcccgagtagctgggactacaggcacctgacaccacgcctggctaatttttgtatttttagtagatattggctttcgctatgttggccgggctggtctcgaactcctgacctcatgagggtgatccacccgcctcagcctcccaaagtgcttggattacaggcgtgagccgctacacctggcctttggctgattaattttaaaagcaattttagtttgatatttccatcactaattttttttttttttttttttgagacagagtctcactctgtcgcccaggttggagtgcagtggtgtgatctcagctcactgcaacctctgcctcctcggttcaagcgattctcctgcctcagccccccgagtagctgaaattacagacgtccgtcaccacactggctaatttttctacttttagtagtgacgaggtttcactatgttggccaggctggtcttgaactcctggcttcaagtgatccacccacctcagcctcccaaagtgctgggattacaggcatgagccaccatgcctggcccctaatttttcttaataaaaacttttaatacatgtctagagtcataatctaggtctccccccaccccaaaacagcccctgagatacgaatttgggggcagatagtttatttgggagatgagcctaggaagtttcagaagggagacagggaaatgagatagggaaaagaagaaaggcagtagagggtatattaatgagcagatgaccactgtgtgggaaactgaggctgtatagtgttgaggagtttggggaggctttatagaacattctctatagaacaacatatagagttgtctcatccagtggacgaggaagctggggacctatccactaactctcagccatcactggttgagggctgccctgggggtgggacactcccaggggtagtggggagagggagaatggcagtggcactgggacccatcaagcctacaggtgagtggcagtgggatgctatcaggccattgtgtgtctttcgcacctactgcccttgtgggagttgatgttgttttaaatctctaatgccttctttttctgatcaactgtttttcttgaaatatcaatttctgaggagcttctgagtcttcctgtgttctgttttgtacagaattctggggagaatttaattttagtttcttgtagtttgttctgctctgcagaagatgccaggaatgatctaaaatatgtacacttcgagatctgttaccagaggtattgatgccatagttgcctggctactgtattgaagatttttccttgagatatttctttattcaaaagtggttctatttttttaatgcgtgattgagcggccaacgaatatcgttctgagcaggtagaaaagttttagtggcgtatctctggattttgcacacgtagatttggcttctcctcacagcagctcaggagaatcactgtagagagaaaactctcctgtgatccctccctttaagaacagatggcgatcttggctctgccatcaagccaaaggaaacatcagtgataaccatcagaggacctgtatgagatgagaaaattcctatgaaaaatgacctagacgcttactcttagcagcacactagaataggtctcgtggtgatcttaggtgacatgcactaaatattattttaacaacaatgccacttttcttgaggttttaaagaatagttgctcagcaagtcagatgaaaggaagttctcaccagcagccagcccttgggggattattcatggatggcaggaatgtgcagaaaaggattcaggagacatgaaggaactatccatgtgctagttttcctgtgcagctgggggtgtgaggatggcccggtaagtggagcacatttatggaaaaatggctattacttgggtatttgggggaaggcttcttgggaggagctagaatctggaaagccatttggagtgacatatgaaacctggagaatagctcctgagtcctttggagtaggaagttccttgattaggcagagcctttgagaaacttggcataagaggaatagaaatgactccatgtggcctggcccgtccctcccggtttgctcctctctagctgccctcatccgccttcagtcttagggcagcaggctgttctcagctgtggatgttagcatatgctgtgcccccgcccagaatactcgttccctcattgcttacctgactgaagctgatgatccttcagggtctagtttcagtgtctctttctgagaaaagctgatgttgcaaagaataccaagtctggaaaggatgttcctattgttactcattctcatagcgcttgctatttccctttatagcactccatttctgtgtttacttgcttaatacctatcatccctcctgctgtactataagcctgagggggcaggggccatggtgtatactaggccgtgatatagccagtgcctagtaacattgtgccacccacagagtaggcactcagtaaagatttgttgaatggggttgggcgcagtggctcatgcctgtcatcccagcactttgggaggtcgaggcaggcagatcacttgaggtcaggagtttgagaccagcctggtctacatggtaaaaccccgtttctactaaaaatacaaaaatgagccaggcatggtggcacatacctgtaatcccagctactcagaaggctgaggcatgagaatcacttgaacccgggaggcggaagttgcagtgagctgagattgtgccactgcagtccagtctgggcgacagagcgagactccatctcaaaaaaaaaaaaaaaaaaaaaaaaaaaagccgggcatggtggctcatgcctgtcatcccagcactttgggaggtcgaggcaggtggatcacttgaggtcaggagtttgagaccagcctggccaacatggtgaaaccccgtctctactaaaaatataaaaaattacccaggtgtggtggtgcgcacctgtaatcccaggtactcgggaggctgaggcaggagaatcaactgaacccgggaagtggagattgcagtgagccgagattgtgtcactgcactccagcctgggcaacagagtcagagtccatctcaaaataataataataataataatgataataataataataataataaaataaaagccaggcatggtaatacatgcctgtagtcccagctacttgggaggctgaggcaggagaatcacttgaacccaggaggcagaggttgcagtgagtcgagatcgcaccactgtactccaatctgggcgacagagtgagactctgcctcaaaaaaaaaaaaaaaaattgttgaatgggtaagtgaatgaagaagtgactaatgatcaactgtggtatagtattagaagagagccacataatgagtgtctgggtgctacagttaatttaaagtttggtagtagaaagtaaacgtattgtattttctttatttatatgtgagtctgtgcttaaaaacaaaaacatccaagtcagacatactcattgtatacagaaaaatataaaaacataattaccgttgataccactacccaaagataaccattgaagtagggtgtggcccaaagcagggaatgcagaaaagtagaggagtccacatgggctaggtcagggtcagtggtgatggaagtcttcctagcgtgagaatccctggtgtctgctaaaaaagggatttgataaaaactcagaggggaacagatcttcctgaccgagggaacccctgccgcctcggtggtgttgacttgtgtattaggctagtgtaactgttgtaacagacagccccacaatttcagtgacttcacatgatggaagtttcttttcactcatgcactattccaatgtggatgtatcctggctgggcagtctcttcttcaggtgatttcttggtgaactcagtctccttacatcttgaggctctgccctctcctggatcctcagatctcctttcagccagatgataggaaaagagcatggtgacttgttagagaggttttgtatctgtgtttggaacagctttgctgagatgtaattctcataccatacaattaacccattttggctggatgcattggctcacacctgtaatcccagcactttgcggggccaaggcaggcggatggcttgagttcaggagttcgagactagcttgggcaacatggcaaaaccctgtctttacaaaaaaatacaaaaaaattaaccaggcattatggtgcatgcctatattcccagctactcgggatggcttgagccctggagtcggaggatgcagtgagatcgtgccactgcactccagcctggacgacggacccaaaccctgtctcaaagacccaaaaaacaacccatttaaagtgtacaagtcggtgggtttttttagcatattcggagttgtacaaccatcactacgatcagttttagaatgttttcatcatcctccccccgccaccaaaagcccatacccattaccacttaaccccacttcccagcttccctcaattcttccccccctattcctaagcaatcactgatccattttggcaacctgttaatgggtaccccctcttcttccgcctcactctctagcctgaggaaaacactagtctcttttctgtctctatggctttgcctgttctggccatttcatataaatggaatcatacaatatgtgttttgtgtgtgtctggcttccttagcatactgtcttcaaggttcatccatgtggtatcatgtgtcaggacttcattcctttttttggcttaatattccattgtacagataggccacactttattaattcatcagttgatgggcatttgagttgtttgcacttttgactgtactagagagggttgtaggagcctgctcaggaagtgatgttcattacttctttccatgtttcatcggccacaagtcagtctcgtgtcctaatctcacttcaagggaacttgggaaatgtggtctggctgagtgcccaggaaaaaaagaaatggggcttggtgatgctgctacaacttgcaaataaggagtagagtttaactggatctatcagcgtggagattcctggtgacatgtcacagagcaggacagagagttcaggcaaggccactcttcagctcctgctgcctttgtgtgaatgggaaagccagcctgggaaatgcccagccccatcagagggcctatcagcccactgtagaccctggccttcacaggtggtgctttgccatcccaggagactgggaaaggttgggatgatggcagctagggtggatgatttcatggtgattgtgcctgatacataactgggtcctatttgtagagtagaaaaacaactattcggatctgtacgtttatttgactctgaacattgttcacactaagacacaggtcgcttctagttgttcccttccatgtatgtaaatacgaggcatctggccagagcagggcacctgctttcttgtggtaggtgtgtatttgtcagggtccaatcgggaaacaaagaccactctaagtatttaaaatagaagaaacttaatgtaggaaattggttacacaggtgatagaagagctgacaaaccaatcggaaatgatgaggcagccctgaagttagcatcagcaggaagctgctgtcacccgcttggctggagggacccagggaagaggtgatgttaccagagcccaggtgccaggatcacctggaacaatcgtgagccagcctggtgggagctgggtctaacaaagagatgtggctattgctggagtggccatgcacaccaagaaaaagtgggagaagaaactgcgctggcttcttccatcccatcctccagggcctcaccctctgcccccagtgcctcccaccggttgctgtcagctgagcacagcagcctagaggagtcagctcccctgtaacacaaagcagggctgcagaaaggccaagaatgcatttgagggcagaccccagtgattgccccagtaggacactattcagaattactgctcagtttctagtatttttaaagtcagctttaataaggtgtaacttacataccataggccgggcactgtgactcatgcctgtaatcctagtactttggcaggccgaggtgggaggatcacttgaggccaggagtttgagaccagcctggacaacacagtgagactctgtctataaaataaaaatgaaaaaattatcttgccttggtggtgtacgcctatagtcccagctactcaggaggctgagatgggaggattgcttgaggctgggagttgaaggctgtggttgagctatgaccatgccacagtattccaacctgggtgacagtgagatcctgtctcaaaaaaccaccatacaataaactaaaattttaagtgcacgatttgatgagtttggccaaataaacacacccatgaaactaccaccacaatcaagatatagaatattatatccctgtgttaggccgttctcatattgctataaagaaataccagagactgggtgatttataaagaaaacaggtttaattggctcacagttctgcagactgtacaagcatggcattggtgtctgctcagcttctggggaggtctcaggcaggttttattcatggcagaaggtgaaggcggagcaggcagctcatatggtgagagggagagtgagggccggtggcacgacctctactcactgcaaccttcaccttctgggtttgagcaattctcctgcctcagactcccgactggctaggattacaggcacctaccaccacacctggctaatttttgtatttttgtagagacagggtttcaccatgttggccagactggtctcaaactcctgacctcaagtgatctgcccgtctcggcctcccaaagtgctgggattacaggcatgagccactgtgcccggactcagtgtgatttttacatttgttggggtttttattgtcactacaggagtgaagacctttcacattcttctacatcttaattggaagcagaagtctcttgtaaggtttttgacaggtgacccaacacaaagtttattctagaaaggacactggtctaatgagaccttttgtgtgttaaagctcagggctggcttagaaggaggatttattgggattctatttgtctcttgccctatgaatttcctcttacagacacacagtatagaaaagagggccagggagacaggatggttgatggcaagtcagtgctctggcacacccatagctcatggcaatgctttgaggtaagcaaagtcagacacttcaggtgaaggactgaggcacagaagggctaagtgccctcctcaaaattcaattgggtaataaatggtgtgaaaatagccaggatctagctctatatgattcccaatccagtgttgtgtttttattctgtgcattttttacataagtaatagatgtgttggctcatgcctgcagtctcagcactttgggaggccaaggcgagaggatcacttgagcctaggagtttgagatcagcctgggccacatagtgagaccccatctctaccaaataaataaataaaaataaaagctaggtgtggtcatgcgtgcctgtattcccagcactctgaggcaggagtttcacttgagcccaggagcttgagcctacagtgagccgtgatcacaccactcagtgcattccacttgggcaacagagcaagaccctgcctcaaaaaaacaaaagtgataatagatgaatatgtttgtatattactgtgaaaaactgaaaaacaatccatttaaagcagttatccctctaaactctaatctcttgtcccgtccatattccggaagtaacctgtcttgtcagtttggtgtaatatccttggagacaattttctatgtactttacatactgtgaaaatatgtcatactgcagagtttttaaactataggaccacacaggaggtatactgttgtttttttcacatagtaatcgatgcttagagatctctccatgtcactacaataactgctcagttagtcattcatttaacagacacttattgatcacctactttgtgccagatccagttctaagtacagtagttaacaaatcagacccaaaaagtctccaccctctcggagcttgcattctaaaatggggagatagaataaaaaaaacctaaatgtattaaaacagtttagggtgatagggtagccagtaagtaggatgggaagattgtaattttaagttgagtgctcagagaagaccacacctattagaaagtgacatggagcaaagatcagaaagaggcaagggaacataccatgtggtatgtgggggaagatcatttcaggtagagggatcagcatgtggaacagcaaggaagcttgtgtagctggagcatagtaggtgatcggggcacaggagtggtaagagatgaggttggagaaataactaggaccacatcttgtagatccttacaggccattggaagaaaattggtgtttgctctaagatgggagccactggtgagttttgagtcgaaggatgacatgacctgccttacagcgcagaggatcactatgacttctgtgttgagactagatagtagagaggtaagtgtggaagcaggaaatgacatggcttggaccagagtggtaagggtgggctttatgaggagtgggtcaatttcagatgtagtttgaaataaaagccagtggaatctcctggtccaataaatggtgttagaggaaccaaacatgactgcaaagtttttggcctgagtaagaggaagaatggattggccatttaacaagaagaggaagactgtagaagaacaggtttgatgggacaatcaagagtttgatttggggccagccatggtggtgcacacttgtaatcccagcacttgaggaggccaaggtgggcagatcacttgaggccaggagttcaagaccaccctggtcatcatggctaaacgctgtttctactaaaaatgcaaaaattagctgggcctggtggtgcacgcctgtaatcccagctacttgggaggctgaggcatgagagtcgcttcagcctgtgagttagaggttgcagtgagctgagaatgcatcacaccattccagcctggatgacagagttgagactctgtctgagggggacaaaaaaaagtttgatttgggacacgttaagtttgaggtatcaacatgcaaatgagttgctgagagggcagttggatatgtgagtctggattttaggggagaggcctaggctggagatagaaatttggaagtcatcaaaatatggatggtttgaaaagtcatggcaatggatgatcaagggatctagggtagttaccaagaaagatgaaatgtccaagggtactgccaagggacactccaatgtgaaaagatcagagagatggactaaagtaggagaaaatcgggcgagtgtggtgtcctgcaaatcagatgataaaagtagtccaaggaggaaggggtgcacggttgtcaaatgcacatgtatgtgaaataggacaaggagtgagaagggagtggtggattcagcaatgatgccaacccactgacgcagaaagtccagcatgagaagcactgatgtctgggtctccagagattcagatttaagctcctaggtgattgaattttttttttctttctttcttttttttttttttgacatggcgtttccctcttgttgcccagactggaggacaatggtgcgatctcggttcactgcaacctccgcctcctgggttcaagtgattctcctatctcagcctcccgagtagctgggactgcaggcacctgccaccatgccctgctaatttttgtatttttagtggagacagggtttcaccatgttggccaggctggtctcgaactcctgacctcaggtaatctgcccgccttggcctcccaaagtgctgggattacaggcgtgagccaccacgcccagcctcccaggtgattctaatatgcagccaagattcagacccactgtcaaagtttccttctcttaattgtgaaatggccttaattgccagaaacagatgttgctggctgattcaacataggagtttttatctgtaggcttgttcttggataccttgggatctggaaatgataagcagatccaaaagctgattattaaccactaaagggattagctatttaacacctgtcttaaagtggcttttaagctgaaaatctctttgcttttaattttttcaaatgtttgatttttgttttgtttatactcaaaagactttttgttttgagtaacaagggtaaatttcaagttaatgagaaaattcaagggaaatcttgatgtaactggtccaaaaaactaaaatccaaacaaacctgagctcatatcactaattaggcattagcttgggcaacatggtgaaaccccgtctctacaaaaactacacaaattagccaggtgtggtagtacgtgcctgtagtcacagctacttgggaggctggggtgggtggatcgcttgagcctgggaggttgaggctgtagtgaaccgagatcgtaccactgcactccagcctgggcgaccctgtctcaaagagaaaaaaaaaaaaaaagcattcaagtgagtttattgagtttagtacattcttttcagaatcatgaatatttcacacctcaaaagttggctaattacagatgtagaaatgttgtgcctcataaaagtttcaatctttttcatattcttgccacagacattagaaattatttaaatgctctagtaaatttgagttggtatctgttggctcttaaaaattaaagaatattatacaatggctgtgcaacaagagatccagtttgcaggttagttcaattagattctatatgacaaaaagaggaaagataaaatatgttagaacaggatcaaggtagaaaatggaaaaagtccgagtcaaaatacaggcttaattattacaggtttccagaaggtcgccaagtgtctagattagccctttccaacccaggttgggttccacaagagaattaagtcctaatgcccgctggcatctattgtatgaagtgattgaatttctcttctgcatccggaatgaggctggctacgtaccatccttgggagcactgaaaaaatagtcactcaaataatcaaataattttttccagggattaattctgtcatggaaccccggttgagaaagtctggccattttagatactaatttgacatctgggatgatgcagtagtttttgaggtgcatgtcctcaggaaagaaaacataaaagagcctattgtggccgggcgcagtggctcacgcctgtaatcccagcactttgggaggccgaggcgggtggatcacctgagatcatgagttcaagaccagcctggccaacatggttaaaccccatttctccttaaaaaaaaaaaaaaaaattaaaaaattagctgggtgtggtggtgcacacctgtaatcctagctacttgggaggctgaggtggaagaatcgcttgaacctgagaggcagagttgcagtgagctgagattgtgccaccacactccaggctgggtgacagagtgagactccatctcaaaaaaaaaacaaaaaaaacctattaccaagaaattaaaaagaataatttattcacttattagaatggttattaataaaatatacccaggaccaccttgtataaatcccagcaatgattttctgaacattttaatatgtatccttacagacttttgtctatgtacattaacatgtgaatgtgtttatttcaaagaatggggtcatgcttttcatttagttcaggttttttccatgagatgttactgttacggatgttcctctgggtaattacacgtggatctgtccctttataatgattacgttattctgtagtctggttgttgcaaaatatattttgctgttcttccgttaatggacatctgagtcatctccagttcattactattacaagcagtgccataacaaacatctttgttcaaaaaattcttgaaaaaagatgtacatattacagattctagaagtggaatcgttgggtcaggatgggtacctgttttgtttttgtttttgtttttatcatgtaaaatcacaaatatatttaaaagtagggaatagtgtaattatcttaggcagggttctccagaggaacaaaccaataggatgtatagagatctagaggaagagatggattatgagaattgcctcaggtgattctagaggctggcaagtcccatgcaagctggagaaccaggaatgcttgtggtgtgatttggtctgagtccaaaggcctgagaaccagggatgctgttggggtaagtcctgaagccagaaggtccaagatccaggaactctgatgtctaagggcaggagatgatgaatttcccagttcaaaaaaagaaaattcactcttccttggcctttttgttctcttggtaccctcaatggattgcgtgatgccacctgcattggtgagggtggtcttctttactcagactcttgattcagatgctaatcttatccagaaacaccctcatagacatacccagaaataacgttttactagctttctggtcttccttagcccagtcaagctgacacataaaattaaccatcacaataataaacccccatctaccccatatccactttgataattatcattgcatggccaattttgttcccctttgcccccacccactcttttataccccaatgctggatttattacaaagcaaagacataccattttatccccagatatttaagtgtgtatctttaaaagctaaggacacttggctgggcacggtgtctcacgcctgtaatcccagaactttgggaggccaaggcgggtggatcacctgaagtcaggagttcaagactagcctggccaacatggtgaaacctctattaacattacaaaaattagttgggcgtggtggtgcatgcctgtaatcccagctacgttggaaggctgaggcacaagaattgcttgaactcaggaggtggaggttgcaatgagttgagatcatgccactgcactccagcctgggcgacaaagcgagactgtctcaaaaaaaaaaaaaaggttaagggcacttacaaaacatagtcatgattacattatcatacctaaaaatgaacagtttttaggttttatattatcatacctaaaaattaacagtttttctgtcagtgctcaaattttcccaattgtctttccttttcttttctttcttttttttttttttgttgagacagagtctcactctgtcacccaggctggagtgcagtggcacaatctcggctcactgccacctctgcctcctgggttcaagtgattctcctgcctcagcctcccaagtagctgggactacaggtgcctgccaccacacctggctaatttttgtagaggcagggtttcaccatgttagccaggctggtctcgaattcctgaccttaagtgatccacccgccttggcctcccaaagtgctgggattacaggtgtgagccactgtacccagcctcatatgttttatagtggatttgtttgaatcacagtccagactatgtatgttgcatttagttgatatgactcttaagtcttttttattatataggtttcctcttcacttattttttcatttccttatgatttacttgttgagatagaatcaagtagggactgagtgtaattgtataaggtttactggtgtggatcttaagcagtggctacattggaaaatgaaaactattatttagaaataatttttctgttaaagtacagcatccttgcacctgtctttcagcatgatgaatgcgtatatgtatttcactgtctttttaaaaaaaaaaaaaaaaaaaaaagcagggtctcactctgtcgcccagactggagtacagtggcatgatcttggttcactgcaacctctgcctcccagtttcaagtgattctcctgcctcatactcccaagtagctgggattacaggcgtgggccactaccacccggctacttgtatttttagtagagacaggttttcaccatgttggccaggctggtgttgaactcctgacctcaaatgatctacccgcttcggcctcccaaagtgctgggattacaggtgggagccactgcacctggcctctactccattgtcttgattgattcatttgtgaccttataacatctatctttcaggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtaaaccctcagcccgagttatgagcacttgcatctcttcaaggaacagaatcgcataggctaaggatgtgcatctcttccttatgtatatgtctgtctgttggcagggagcaaacatttgtagtaaatgtggtctgggaattttcagattccctttttgagagaaaaccatgagaaacagggttttctactggtcacactcttcccacaggtacacttgtttatgggccaagaaggaggcccagcacactccttccgagctcccacttccagagccttgtccaccaccaccagggcatcatcttcccagtgatctgttcattcattcacttattcattcatttatttaacaatgttcagtgatggcttactgtgtgccagaaacttttctaggtggtggggatacagacacaacggacgtgaatcctgcccttgggggccttgcattgctggtgagggaagttaaagaaagtgacacattaggatgtcatctgagggctatggggaaaggttaagcagggaaggggataaaggagggctcggaggggtggtctgcaattttaaatagggtagtcagtgaaggtgcctaaagatagaaaagtgataagggagtgaacttcacagataactggagaaagtgttcttggtggaggaaacagcaagggcagagactctgaggatgaagcatggcaggcacactccaggatggtcagcactaagcaaggggtgagtggagagcaacatgaaacaggaagagggtaagaccttcttgctctgagtgagaaggaacatcaaatggagggtttgagcagaggagtgacaagattggacatgcattttaacaagagtactcactgttatgcaaagaatatattttagggagtgtatcagctatcacttgctgcgtaacaaccccaaaacttagcagcttcgaacagcaatgattatgatttttcatgattctgtggctttgccaggcacttcttctgctggcttcacctgggctggcttctaaaactgaagtcagctgtagggtcaggtgtggctggaagatccaaatgaccccgtacacatttggcagctggtgttggctactgatactgtaccttagctctccaccatgtggttctaatcctggtagaccagctttcttacctggtatgcagaactctaagagagtgaacaagggagcagcaaagcctctagaggcttaggttcgggaactcacacgtggttacttctgccacatgctattggtcaaagcaaatcacaaggtccgcccacattcaaaagggtggaggaatgtgctccacctctggctaggaggaatagcaaagttgcattgcaaaggtgcatgcatattgcgatgggaggaatttgtggccattaaacagtctatcacagggacaaggacagaagcagggaacaggagaatatagcagtaattcaggggagagctggtggtggcttgagccagggtggtggggacaaaaatgttgagaaagttggatgcaggatatattccgaaggtggaaccaacaggcccacatcattcatttccatcataagagctcttgacattgctgttctgctttcattcaattctaactgcttcctctctctctctctctctctctctctctctctctctctctctctctctctctctctctctcttcctttcatacacacaggaggctctgtcctccccaccttctctccatccacacttacttctctgacaatcccagccactctcacacctagggacccttagctggagctctccaacccaacatcctaagtgatggccttacacctccccccctttgtccacctgttctacctcaagatgatgttgatatttcagactcaacattttgaaggctgaagtcatttactcttctccacaaggtatggcttccaatgtcttactttcttactactattctctaccctcctaggtctaaactttcagtcagtgttggattcattttgctcacttacctccccgtccagtcaggccccatttgcagcccttctgcgagccttctttcactgcttgccagtcctttcccatcaccactgcccccagtcactgccattttctttttaactttcttgccaggaatgttctaacagtacccaagtagactccctgcttgctgtctgctcagtctatccttcacagatttatagcttattcttcctaaagctcaagaacccaccatggctccctgctccctgctatataaaaattcagactctcagatcaccattctaggtgtcctgaacactttctccaacctacctctagccttgtttcccactacctggtgtgtgtccaactaaactgtagttcctaaggagttttccaaactcctgtctctgttcctgttttctatgctgagggctccctttccaaatcactgctgtttcatttctcttgccctttttttttctttttttgagactgagtctcactctgtcacccaggctggagtgcagtggtgtgatctcggctcactgcaacctccacctccctggttcaagcaattcccctgcctcagcctcctgaatagctgggattacaggcacatgccaccatgcccggctaatttttttgtatttttaatagagatggggtttcaccatgttggccagactggtctcaaactcctgacctcaggcaatccacctacctcggcctctcgaagtgctggtattacaggcgtgagccaccacacccggcctcatttctctttatttttatgccatatctcaagtatctaggtgagatagccctatatgtcttctgtgagttcctccagacttgaatttgtgtgattttaagataccatattcttgcttacattgtcactaattatgtgtagatcttattcccttccaccatagtgtaagtccttggaacataatgacctcattttctttttttaaatttccagtagttcctaatgcaccatgtggtggagaggagtcactcagggtatcgaagggaagttaatgtttggtaaagccaaaacagaaaactgtgttcccactatggtggtggggaattcagtccccaggtcagaaaatcactgcctttggttccttcaagaaagtcctaggagtttttctccagcggcttcagaaggtggtggcggtaggtgcagaagcaaatgaagcttcgtcttctgctcagggcgtggtggctgtggataagatctatcttggatatcatctaacccacactctccagtgcagacacggagcatatggctcagggaggtagggagctggtccaagaccacagggctggttagtggtgaatctggaactatggtcctgcctggagttcagatcttctctgcccctaagttgggcctgcttgacttctggaggagcaaccctttctgccctcttctcagtatgacttttcatagtagaagaaaataaaacagtcacatctagaaggatgtagaatttaaaattcccaaaacacacaggaaaaaaagggttgaattttgttgactaaggtaggaaggactttctcggtgtcctctgatctgagggtatttgtattatgcctcagaattgataatgccatattttaactgacttcaatgataacttctcctttcaagaattaatattttgttgttgaattctcttgccatcacataagtgacaaaattactactagcaagtctttggtataaatggtgccacttaaagacatttgtgtcattacttcattgagttctttttttcctgcctataattttcatactcgttcatagaacagaaatgaacttttcatgtatagaaaaagatgagagtgaaaatgtcactgttaacctttggtgtaaaaataggattcccaattttgtatcctgttgcttatcctgatatagtagatccctgtccctggcctcactttgccactgctcctatagttatttgggatccaggattttggcaatacggcttcctgcatgaaaaaacaactccatattgttaaaagcaaacaaacagcttgcagagaaatggcctaccattgatgccatttcgatgtaataaaaaatactcaatgcataattggaatccaactttagaaacaaggtttaggtgggcagggtggctcatgtctgtaatcccagctacttgggaggctgaggtgggaggatcgcttgagcccaggggttcaaggctgcagctatgattgtgccattgcactccagcctgggtgacagagtgagaccctgtgttttaaaaaatgaaaaaaaaaatgcataggtgtgtgcatgatggcacaaacctgtggtcctagctgcttgggaggctgaggtggaaggattgcttagatgcaggagtttcaggctgcagtgaactatgattacaccactgtactccagacatcaaatcgtggtgatcttttgggagtaggattagaattgattttaaatttcttttgtgtacttcatgatgatttccctattttatatagtccctgaggcttttataataaaaatcctatgagcaaaaaaaaattaaaactccctagtgtaagttactgtgttgctattatgactttttttttttttttttttttttttggagacagattctcgctctgtcacccaggctggagtgcagtggcacgatcttggctcactgcaggttccacctcccgggttcaagctaattctcctgcctcagcctcccgagtagctgggattacaggcacacaccaccacacccagctaatttttgtagtttttttgcagagatggggtttcaccgttttggccaggctggccttaaactcctggcctcaagtggtccacgtgcctcggcctcccaaagtgctgggattacaggcatgagccacggtgcctggcctattaagacatttttaaagttactagagagctgcatgtggctgttggtaaaggtggtggtgggaggcgaggggaatgggcaacaacaaatttagagaaagaaaacttttcatgagaaagttggtttataccattatttaaacattttttgttgtaatataataatactttggtggttctgtaattataggtatcgcaaagggtttgaactccagtcatccctctattcgggaattaatcttgcagttttgctgattgttgctggacaacaatttgaaacttccttggaactaaggaaaataggtaaagctgcttattattgcagatgttgttgctttgattatacaagtttggcattaaaagttatgttgaaataactagcattatatcattatatttctattctttttttgagacagagtcttgctcggttgcccaggctggagtgtagtggtgtgatcttggctcactgcaacctccgcctcccgagttcaagcaattctcctgcctcagcctcctgagtagctgggattacaggtgcccaccaccacgcccagctaattttttttgtatttttagtagagatggggtttcaccatggtggacaggctggtctcgaactcttgacctcaagtgatccgcctacctcagcctcccaaagtgctgggattacaggcgtgagccaccgtgcccgtactactagaattatatttcaaaaggaacaatcagttacttttcctatagcacacctgagacagcagccaaaataaaatacctgcttatcctcagtatgacagaaactaaaaaagattattctgactatcaaaaattcaaattcttaaggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtgagttgtgtctgtgtgttgtcatcacccatctcaatacatgatcttgttctgaaatgtcttccttataatcactatgtttctccttctgacttttcattaaagcaaagttagcacagacacaactgctctgagaattcccttgcttttatgtgaagggagggaaagacagatccacacagaatatatccctgcctgctccacccctgagattaggccttctattctattaatttctgcaggttgtctaggtcctcaagagaaaaacactcttggctactagtatgtattatgcatttgtgagaaagcatataataaaatgaaaaaagcacaccaagaaaatgtttatcacaaatgaaaactggaactaaaagaacaataatagggtatggtaaataaaacggtggcacagcaacagccttacacggccatttaaatgtgcaggaaagaatgtttggagatgtggaagtgtgttcgtggtttgttgtagagtaagaaaagccagtccccgggtaagtttttctgtatcagtggttctcaaattctgttgtgtgtcagaatcaacctatgttgattaaaacacagactgggtgtagtgacttatacctgtaatcctggcactctcggaggccgaggtgggaggattgcttgagcccagtagcttgagaccagactgggtaatagagtgagacccagtgtctacaaaaaaaaaaaaaaatagccaggcatggtggtgcacgcctgtggtcccagctactcgggaaggcagaggtagaaggatcgcttgagcctgggaggtcaaggctgcagcgagctgtgattgcacaactgcaatccagcctgggtgacagagtgagaccctgtctcaaaaataaataggtaaaataaagaaagaaaacacagattgctgggcccactctcagaatttctggcccagtaggtctggggtggacgcctgagaatttgcacttacaaattacaagctgctgctgctgctctggtgaccacactttgagaaccactgttctatatgatcttgttttaattaaaaatatgtgtttggcatgtgacttgtagggaaaggcccaggaggggtggacagtattggatttccccatagacatgaagctccgttagaattgtggtaacaaacctgcatgttgcacacatttaccctagaacttaaagcataaaaaaatatatatatatatgtatatatatgtgtgtatatatatgtgtatatatatgtgtgtatatatgtgtgtatatatatgtgtatatatatgtatatatatgtgtgtacatatatgtgtgtatatatgtgtgtgtgtgtgtgtatatatacatgatttgctggaaggactcacagaactcagaaaagctgttacactcttagttatggtttattacaatgaaaggatacagattaaaatcagcaaaggcagaaaggtacatagggtagagtccaggagagaccacgtgcaagcttccagttgtcctttcccagtggagtcatgtgaatagtgcttaattctcccagcaaaaatgtgtgacaacatgcatgaaatcttgccaaccagtaaagctcattgagccttaatgtccagggtttttattggggatgggtcatgtgggcatggagtcttcatgcagctgatattaatacctcagctccaacctctctagaggtcgaactgatacagtgtggcccagggccccgaagatgaatcatatcgttagcatagactatctgggatggcccaaggtcccagataaacagagatgctcttagctggcagtatatcccaagggcttagaggtgatctcccaatagccagtccagggccagatctttcttttgaatgtgtggagttgggacaacacaggcctgctgagtgcccaagcaagtcggttggagtctagctggcctatcttcccaggatagctccagcttttatccttaaagagcaaaataatactatgatgctttcagttgaaccattccgtttagtaccaaagaggttgtgaccaccactgcctggcaactatattccaaaaagttcagtttgcctgaaaagagcaaaggtgtggtcagagtcaagatgtcataacatcaaaatctacctagtcagattctaatatttcaaaaaataaaagacagtgagtttgactagtgattgccagaagtaagggagggggtgggatgggagggaggtaggcgtgatggtgggaaggcaacacaaggggtccctgtggggatggaaatttctctaacttgccttgtatcagtgacaacatcccggttgtgatacagtactatagttctttttttttcttttttttctttttttcttattatactttaagttttagggtacatgtgcacaacgtgcaggttacttacatatctatacatgtgccatgttggtgtgctgcacccattaactcatcatttaacattagatatatctcctaatgctaaccctcccccgcccccaccccataacaggccccggtgtgtggtgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcgtccttttttatggctgtatagtattccatggtgtatatgtgccacattttcttaattcagtctatcgttgttggacatttggcttggttccaagtgtttgctattgtgaatagtgccactataaacatacctgtgcatgagtctttatagcagcatgatttataatcctttgggtatatacccagtaatgggatggctgggtcaaatggtattactagttctagatgtctgaggaattgccacactgacttctacaatggttgaattagtttacagtcccaccaacagtgtaaaagtgttcctatttctccacatcctctccagcacctgttgtttcctgactttttaatgatcgccattctaactggtgtgagatggtatctcattgtagttttggtttgcatttttctgatggccagtgatgatcattttttcatgtgtcttttggctgcataaatgtctttttttgagaagtgtctgttcatattctttgcccactttttgatgggattgtttgtttttttcttgtaaatttgttggagtttattgtagattctggatattagccatttgtcagatgagtagattgcaaaaattttctcccattctgtaggttgcatgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgcataaggtgtaaggaagggatccagtttcagctttctccatatggctagccagttttcccagcaccatttattaaatagggactcctttccccattgcttgtttttgtcaggtttgtcacagatcagatagttgtagctatgcggcattatttctgagggctctgttctgttccattggtctatatctctgttttggtaccagtagcatgctgttttggttaccgtagccttgtagtatagtttgaagtcaggtagtgtgatgcctccagctttgttcttttggcttaggattgtcttggcaatgcaggctcttttttggttccatatgaactttaaagtagttttttccaattccatgaagaaagtcattggtagcttgatggggatggcattgaatctataaattaccttgggcagtatggccattttcacgatattgattcttcctacccaggagcatggaaagttcttccgtttccttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttagtggtgtataagaatgcttgtgatttttgcacattgattttgtatcctgagactttgctgaagttgcttatcagcttgagattttgggcgagacgatggggttttctagatatccaatcatgtcatctgcaaacagggacaatttgacttcctcttttcctaattgaataccctttatttccttctcctgcctgattaccctggccagaacttccaacactatgttgaataggagcggtgagagagggcatccctgtcttgtgccagttttcaaagggaatgcttccagtttttgcccattcagtatgatattggctgtgggtttgtcatagatacctcttattattttgagatacgtcccatcaatacctaatgtattgagagtttttagcatgaagcgttgttgaattttgtcaaaggccttttctgcatctattgagataatcatgtggtttttctctttggttctgtttatatgctggattacatttattgatttgcatgtgttgaaccagccttgcatcccagggatgaagcccacttgatcatggtggataagcttttgatatgctgctggattccgtttgccagtactttattgaggatttttgcattgatgttcatcaaggatattggtctaaaattctcttttttggttgtgtctctgccaggctttggtatcaggatgatgctggcctcataaaatgagttagggaggattccctctttttctattgattggaatagtttcagaaggaatggtaccagctcctcattgtacctctggtagaattcggctgtgaattcatctggtcctggactttttttggttggtaagctattattgcctcaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgcatctgtttgattcttctctcttttctttattagtcttgctagcagtctatcaattttgttgatcttttcaaaaaaccagctcctggattcattgatttttttgaagggttttttgtgtctctatttccttcagttctgctctgatcttagttatttcttgccttctgctagcttttgaatgtgtttgctcttgcttctctagttcttgtaattgtgatgttagggtgtcaattttggatcttcctgctttctcttgtgggcatttagtgctataaatttccctctacacactactttgaatgtgtcccagagattctggtatgttgtgtcttttttctcattggtttcaaagaacatctttatttctgccttcatttcgttatgtacccagtagtcattcaggagtaggttgttcagtttccatgtagttgagcggttttgagtgagtttcttaatcatgagtactagtttgattgcactgtggtctgagagagagtttgttataatttctgttctttcacatttgctaaggagtgctttacttccaactatgtggtcaattttgaaataagtgcagtgtggtgctgagaagaatgtatattctgttgatttggggtggagagttctgtagatgtctattaggtctgcttggtgcagagctgagttcaattcctggatatccttgttaactttctgtctcgtggatctgtctaatgttgacagtggggtgttaaagtctcccattattattgtgtgggagtctaagtctctttgtaggtctctaaggacttgctttatgaatgtgggtgttcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccgtttattttgagcctatgtgtgtctctgcacgtgagatgggtttcctgaatacagcacactgatgggtcttgactctttatccaatttgccagtctgtgtcttttaattggggcatttagcccatttatatttaaggttaaaattgttatgtgtgaatttgattctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgagaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgcagagagatcagctgttagtctgatgggcttccctttgtgggtaacctgacctctctctctggcttcccttaacattttttccttcatttcaactttggtgaatctgacaattatgtgtcttggagttgctcttctcgaggagtatctttgtggtgttctctgtatttcctgaatttgaatgttggcctgccttgctagtttggggaagttctcctagatactgtcctgcagagtgttttccagcttggttccattctctctgtcactttcaggtacaccaatcagatgtagatttggtcttttcacatagtcccatatttcttggtggctttgttcgtttatttttattctttttttctctaaacttctcacttcatttcattcatttgatcttccatcactgataccctttcttccagttgatcgaatcggctaccgaggcttgtgcattcatcacatagttcttgtgccttggttttcagctccatcaggtcctttaaggacttctctgcattggttattctagttagccgtttgtctaattttttttcaaggtttttaacttctttgccatgggttcgaacttcctcctttagctcggagtagtttgattgtctgaagtcttcttctcttaactcgtcaaagtcattctccgtccagctttgttccattgctggtgaggagctgcgttcctttggaggaggagaggtgctctgatttttagagtttccagtttttctgctctgtttcttccccatctttgtggttttatctacctttggtctttgatgaaggtgacgtacagatggggttttggtgtggatgtcctttctgtttgttagttttccttctaacactcaggaccctcagctgcaggtctgttggagtttgctggaggtccactccagaccctgtttgcctgggtatcagcagcagaggctgcagaacagcggatattggtgaacagcagatgttgttgcctgatcattcctctggaagttttgtctcagaggagtacccagccgtgtgaggtgtcagtctgcccctactggggggtgcctcccagttaggctacttgggggtcagggacccacttgaggaggcagtctgtccattctcagatctcgagctgcgtgctgggagaaccactactctcttcaaagctgtcagaccgggacatttaagtctgcagaggattctgatgccttttgtctggctgtgccctgcccccagaggtggagtctagagaggcaggcaggcctccttgagctgaggtgggctccacccagttcgagcttcccggaggctttgtttacctactcaagcctcggcagtggtgggcgcccctcccccagcctcactgccgccttgcagtttgatctcagactgctgtgctagcaatgagtgaggctctgggcgtaggaccctctgagccaggcgcgggatataatctcctggtgtgccatttgctaagaccattggaaaagcgcagtattagggtgggagcgacccgattttccaggtgccgtctgtcaccccttgctttgactaggaaagggaattccctgaccccttgtgcttcccgggtgaggcagtgcctcgccctgctttagctcacgcttggtgcgctgcaccccctgtcctgcacccactttccaacactccccagtgagatgtacctggtacctcagttggaaatgcagaaatcacccgtcttctgcatcgctcatgctgggggctgtcgactggagttgttcgtattcagccatcttggctctaccaaaaactgtactatagttttgtaagatgctaccattggagtaaacctggtcaaagatatatgggttctctctgtattggttcttagcacttcatgtaaatctaaaattacctcaaaataacatgtttaattaaaaagaaaatgagtttgaaattttgtcattttgtaattgctttgaactttgaactacagctgacccttgaacaatgtgggagttaggggctcagttgaaaattcaccaaaaacttaactacgaatagcctactgttgactggaagccttaccaataacataaacaatattttgtattttatattttgcaaaaagtgcaggattttcgcaaccactgacaactgcagtgacggcttcatgaatttccttttctgtttctcctacgatttttaggctggcttcatttatcttgaaatggcagcagccgtaactgcagaactcaatctgcaatacatatcaagcaattcaactttttctggtaatgtcatgacttttctcggcttcttgggagcatttccagtatcactagtggcactctctatgggtcccatggtgttattcattgtttatggtgtcacactaaatacaatgaagaatgcacgagaaccgtgagtgatcactttttactatgatctgcaatttactggagagacgaacttctcatgcaaaaatgatcagtctcacacggtggaagttttttttttttggttgtttgtttttgagacagagtctcgctctgttgcccaggctggagtgcagtggcacaatctcagctcactgcaacctccgtctctcagcttcaagcattccttctgcctcagcctcccaagtagttgggactatagacgcctgccaccgcatcctgctaatttttgtatttttagtagagacaggatttcaccatgttggccaggctggtcttggactcctgacctcaggtcatctgcccacctaggcctcccaaagtgctgggattacaggtgtgagccaccgcacctggccacatggtggagttttaagcagatacttacaacaggagctcaccacaatagcaacaggaggtggctatgaaattcttacagtagtgcagtatgcactacagttaattttatgcagttttgatataataccacatctttacatttgtttatatttttcttgactgggaatggtgccatatacagtctgtaagtgtgtgtgtaagttttggtacattttaactttttgtaagagatttgtatatatgttgggtagtaaatgataaaatggaccagtacctacatatattttatgtgttcatggcatacctagctttttctaatttttttttttatatttctaggcttcacagtttatctgcaaagtttttcaaattgtcgcacgtctccagaacattttccaatgtatctattgggaaaaaaaatccatgtataagtggagctgcgcagttcatacctgtgttgttcaagagtcagctgtgcctgcccttgttatttaaaacagttaccacatgctttccaatctccacattttaggcagtaggtactaaaattggggttagcacaatgttggtaaaaagccacgttgtgttattttgttggatggacttactttgcctactgctcgtgttttcttaattagttttgtggctgctgagcagtcgtttatgaagcactcatgacataatatgaatttaagtgaataaaagcttttggaaagcttcttttaaagggacttgaattgaattcagtttctttaggaatccaatatattgctgtttgtgatttttccaggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccagtaagatatgctaaatccatttttttttaagattaggaaaaaaactagggattggtgctatttaactattgaatactctgaactgaagaaaactgtagagtaattttaaatgttgggataaacatcaatcttatgtgaaatcagtaagtgatagatcagctcactcatagatcattggccatatcctctatagtagtcattctcaattggaagcaactttgtccccctaaggtacatctggtaatgtccggagacatttttggtggtcatgacttggggagaaggtggcactactggcatctgctggatagagaccagggatgctgttgaacatcccacaatgcacaggacagccccctccaataaagaattatccagcccaaaatgtcactagtgccaaagtggacaaactttcctctaaaacaatgtagcaccacgagtggaaacttggaattcagcgtggtttcctgttaagctttggtttgcctctaaggccactaattgatatttaaaagttaccaaaaaggcaaaattgcttttagcttttccttgagtttttgttttaatgttatgaccgtcttagagtcatgagtgaaatatgtgaatgtcttggaaattgaacttcagataattgtgttccatatttatgcgttgagaatttgtgaacatgccatttccaagaatttcattaagcatctaataaaatattgtttgaaatgattatgataattattttgttgccggttaataatacattttaaaatctttttttagttatgaaatatttcaaacctactgaaaggtacaaaaaaataatggagcagacaaccgcgtaatctctaaccaggtttagtgatcttaaacatgttgttttatttgttttggagatttattccctctctccctcctcatctcacccctcctctttctcttcccctcctcttttttttttttttttctttttttgagacggagtctcgtgcagtggtgcaacctcggctcactgcaacctccgcctcctgggttcaagtgattctcctgcctcagcctcctgagtagctgggattacaggtgtataccaccacacccatctaatttttgtatttttagtagagacagggcttcaccacgttggccaggctggtctcgaactcctgacctcaagtgatccgcctgctttggcctcccaaagtgccctcctccttctctcccgattttcttcctttggcctccttcttctctccttttccccttttctctttttcgtccccttctgttctttctccccaccttttctctccccactctcctcctcctcaccctcttctccctctctcccctcccctcctctcttttaacaaagtaacaccttactgatgggctatcacctctttttttatctcctttcatcttccccacccccccccccaagagatggcatctcaatatgttgtccttgaactcctgggctcaagtgatcctccgacctcaacctcccaaagtgctgggattacaggcgtgagccactgtgcctggccctcagtgaggatatattgagtacggacctccccgcctcctcgctgggcagggtgcgctatgttttctacccatgtacgttaacaggcatctgttcttgtttcaggttctggtcatagagccaaccaaagtgtaccagccttcttatgtttccataaacaatgaagccgaggagagaacagtttctttatggcatgtctcacccacagaaatggtaaggaggaaaaatcacaagcaatttaatcagttttcaaataggagagtctagatggtagtatttgaaggaaaaggcacccatgtttaacttctgaattatgagaatatatgagagagtatcatcacagatgagagacagtaggtttttccattttgtgtgtgtgtgggcatgtgtgtgtgtgggcatgtggtgaggtgtgggggtgggggagtgtgtgtgtgtgtgtgtgtgtgtgtgtgtataaaaacattaaaacaaatacaggttggtttgtttttttatagttaaaccttagggaagtgggtagaggatacaggctggtgtgttgtttcacagctgtagtcccaacacttttggaggccaaggcaggcgggttgcttgagcccaggagttcaagaccagcctgggtgacacatcaaaaccccgtctctataaaaaataaatttaaaaaattagccgggtgtggtggtgcacacctgtagtcccaactacttgggaggctgaagtgggaggatcgcttgaacctgggaggtcgaggccacagtgagctatcattgcaccactgcactcgagcctgggcaacagtgagaccctgtctctagaaaaataaaatagtaatatatttttagaagcacttatactggctttcttgatattcctcaactattactggatcctgtggctttccagataaaactcagactcttttactaagtgttcaagtccctccctatataatcctgccccctcccttcctctttctcttcagccctcagtgccagtcaggctgtcctcttactcgcccctgagctgtccctgcgggagctcctgtctaccctttcatttccatccttgttccttttgggatttccttcttccgattatccaagtcctagcttttgcaaagtcatctttaaccactccttcattccttccgctgagtgtctgtaggctaccaattgcctgtatcatgcacagaagaacatcctaagaatgcccatacatgacttgtatgtttgtagctgtaggagctatggaacagttacccactcctgaacaaatgcctgttgattattacataaaatgtgttgtttacttaactagtaaatgttcctcccaaatcaagaagttctctaaagccaccgtggaatagacctgccattggggaagtctttggaaactcatgtggctaagctttctgtatatgtgcagcctcctgcaggtggctgtgggttagacaagactcttgagtctgccctggctcccatttctgtgcctgaatccaaaggccgactcctgctgtctgccactatcctctctgcatgactttggactcatgtctcctctgaagtacacttagcctttctatgcagttggatgtgatttgctggctttcatattctcctaccctcttatgagaagcctccagtggcttcctgtctcacgcagagtcaaagctgacatcccgagggtggcctagaagtcctgcatgatttgcccatgagctctccaacctcctcttctactcccatcccgctcactccactgtagccatatttgcctctttgttggtccccgaacgtgccaggcacacccctcctcagggcctttgcacttgctgttccctctgcctggaactcttcccccaggcatccacgtggcttccttcttcccccactttagctttctgttcagaagtcatcagcgacgcctaccctgaacatcctgttgaacaacgtgaccccctgccctatcttaatgcccttccctactttatttgtcttcataacacttttcaccgccccccatggtatgattttactatttaatctattgtccatctctcttcactcacatgcaaggcccatgagggcaggaactttgtggttctctgctgtgtcttcagtattagtactttgcctagcacatacatagtaggtgcttgatcaacacgtatgactaaaacttctcccatcggaaaccatcttcccagtctgttcctgttgtcattgctccaggatggcaagaaactagtcatgtgcctattcatggcagttctcttgagccaaatgctcagtcacatggttctcatacttttcttccctgggtggcttagttggtcacttgtgacattcctcaggccaaccaaatggaatttttttttttttttgaggcagggtctcattctgtcacctaggctggagtgcagtggagtgattttggctcactggaacctctgcctcccaggttcaactgattgtcccatctcagcctcctgagttgctgggactacaggcgtgtgctaccatgctcagctcatttttgtatttttagtagagacggggtttcagcatgttggccaggctgatctcgaactcctgacctcaagtgatcgcccccacacctcggcctcccagagcgctgggattacaggtgtaagccaccacgcctggcccaaatggattttcctacttaaaattattttctgcaattgtgatgtattgatgttattgcctatggattttccaaaactggagtttcagatgttccttctcaggcttagctttgtgcaaagtgtagtggtagtgaagggaggggaccgagttagtttttgtttgtaagtgcaacttgggtgctgtttgaaatcccagttagtttttttattagtcatggtaggctagcttctaaaacaaacagcccccaaatctcaatatcttaacatgataaaagtttatctatgcctcatgtcatatccaggttgcagagggtggcggtggggggcattccatcttgcagtggatggggaaagaggaaatagagggttgctgtggagtttttgagtcaggcctgcaggtgatgcacagcattcctgctcacatcccattggccaaaactccactgtatatctctctagctgcaagggaggctgggaattgtagttcagctctatgttcagggagaaaaggaagactgatgaatgctgaaaggtgtctgtcgcagtcttgcctctcccaacatttttgcaagtcactcaacttaggtgggctagtcccatgcttgttttagagtttgcctactatgttgacagaagatgaaaagccactcactgtgtgtttattctatgcttattatttctatctgaaacttagattatttcaaatttacatcatttaaactggattagagatacaaatgaatttttataatacataagaaaatgtttctggtgttccatgttatacaaggtgtattgctgtaacccgtaaaaaaatcaccactgcaggtaaaatagcagaaatgattgaccatagaatgaaacaaaaaaaatcatttgctttaaaaaactcaaactattgacttctgtctttgataacttgcagaaacagatgcacgaatggaattttacagcctcttccataaagggaataaggtaagaacataggagaaaatggagttactattttaatgcaaatgatgataatgttttatgcactttaatgtttccacttactcataatatggaatgttcttatttttaatggaatccaaagtggactctctattatgttgtccttcctgagctagttattaatactagtgtactcctagtgagaacttcttgggttattataatagagtagctttgctcatattcagcagactaaactcacttgtgccattttttttaaagaagtgatcggtaggaagagaagatgtatcttttttgagccaaagatgttcaagtgctcagtgactctgagaactgaagccaggagatgattagtggcaacactcgggttggggtcttgtgaacagagtaatggagctgggagatttttttcagggagggcatgaggtggtgtattctcgggagaggagtagctcttgcattttggttcaggagtgatgacagtttgagcctgagctgtgtggccttacccaagcagggctaaacatctcagctgcacttgtcaccctggcagctcattcgagggtgagactggctgtgaagtagatgtgagttctaatctctctttgctgggtgatgttaggaaagtcactcagcttctctaagtctcagtttcttccctattttcttcaaataaagggcttgtactagaacattcctttctctgactctgaggctacctcagccactgaatgaatccccagttacttctagacatagtgtgatcctgtcctggaaacatcagtattgaaattaggataccatcaacatcacttaaaaggagggaaataatttaagtacaaagtagtgcattgggatgatactgcccaggaaatacaaggcaatttgaaatacactcagcaaagcatacacaaagcagcagaaaagggaataaaatatggtctctgtcctcaaggagtttatagtctcatgaaaaggaaaggtaaggtatttgagaaataatttattgtggtattacaagaatttctagactcggaaaatatcaggacacagtatttgtggccacacgagggaaatggaaataaacacggcactgtagctcaagaaaggcctttctttaaatgttatctggtccatctccacccagtgtgtgtacctgactctacagctcatccagcaagcaatattcagcttgcctgagcatagctagtgacagaaaatctgctagtaaaatatgtatttttattttttaaattattttattttattttatttttttgtcttgctctgtcacccaggctggagtacagtggcacgatctcggctcactgcaacctctgcctcccaggttcaagcgattctcctgcctcagcctccagagtagctgggactacaggtgtgtggcacaatgcctggctgatttttgtattttttgtagagtcagggttttgccatgttggtcaggctggtctcgaactcctgacctcaagtgatccgcccgcgtcagcctcccaaaatgctaggattacaggcatgagccactgtgccttgtgaagattttcaaaaatgtgttacttagtaattaagttgtgttagagcaggtagtcaagatccttctgtttgtgcctcctcatagagatacctctaggtgccatttcagccatcagtggggatttacaaagggcctgagggcgtatcatcctcgccccacccctccccgggacccatgtgacctgaagagtatactttgagcgttccagaggctctccaactaactgtggtggttgctttacagattgattttcaaaacctgctcacttataatctagttctaattctttttgaatctcctctgtactcttggtgttccaacccagtgtttgtcatgcaatctataacataaagaatggtctaggacagtttggatctcagcaagagataacttagaaaggatgagataaagtggcttcagttgtttgaagggacaatgatagaagagaatctagccttcctctccataatacctcctggcatgagggccactgctctctgacatacaatctactagcagatttcctgtcactggctatgtccaggcaagctgaatattgcttgttggatgagctgtagaatcaggtacagaccctgggtggagatggaccagataacaaacatttaaaggcctttcttgagctacagtgccatgtttatttccatttcccttgtgtggccacaaatactgtgtcctgatactttccgaatctagaaattcccttaataccacaataaattatttcacaaataccttgcctttctttttcatgagattataagccccttgaggacagagaaccatattttattcccctttctgttgcccgtatgctttgcttagcactgaattatattaagagtaagttcatattaaggtcagttgataaatacaaactcaaatataagcaagataaatgtctctggtatttaaatttcatagagaaataaaaggcagactcggggggtgtttgtttaaaacattaatgaatctttcaggaattgataaaatagaagaaaagattgtcttgcagatttagagtgggtatcataacttatgtataaacattatgctttgaaattttacagcctatcaaagtttgatgaaaggtgttgttttctttatgtccatgataattctgatgactttcaaatctacttttccaccgaagagcagtgcagtaggtgagttacagccaattcaggtatttgcaatgtaattatggcgaatcatttttaaagggcctttgttctgaaagatatttacttgctattactgtctttcttgaaatgttaacttacatctcaaaaaagctctaaaatttctgtaattcacatagcaggtaattcagccatttaaaatacacaacttggccaggtgcagtagctcacgcctgtaatctcagcactttgggaggctgaggagggtggatcacctgaggttaggagtttgagaccagcctgaccaacatggagaaaccctgcctctactaaaaatacaaaattagccgggtgtggtggcgcatgcctgtaatcccagctacttgagaggctgaggcaggagaatcacttgaacccgggaagtggaggttgcagtgagctgagattgtgccattgcaccccagcctggggaacaagagcgaaactccacttcaaaaaaataaataacataacattcagcattttttagtatagtcatagttttccaaccaacaccataatctagttttagaatattttcgtcacccccacaagaaacacactatccatagagtcattcctcattccctcaacctcgccccatcttggccccagccctaggtaaccattaatctttgtgtctctatggctctgcctattctggccatttcatataagtggaatcatacagtatgtggtctcttgtgactggcttctttcacttagcgtaatttttttaaggtttatccatgtgtaacacgtatcagtacttcatttctttttgtggctgaatgatattcttttgtatggctataccacagtttatctgtttttcagccaataggcatttggattgtttgcactttttgacaattatgaattgtacttccctgaacattcacgtgcaagtatttgtgaggacatgtttttatttctcttggagtcaaattgctgggtcttatggtaactctacgtttaaccttttgaggaactgccagaccattttcccattttatattcccattagcaatgtatgtggcttccaatttctccacgtccttgccaacactagttattatctgtcttttgagtattgtaatcctagtggatgtgaggtgggatctcattgtggttttgattcgcattttcctgacgactaatgatactgagcatcatttcatgtgcttattggccatttatatacctctggagaaatgtctattcaaattcttagtccaattaaaaaaattaaactttttatttttgaaaatatttacagccataggaaagtttcaaaatacaatacaaagaatttccatatacgtttcacacagaatttctcagggtttaccccttaccacattggttttacattctcgctctatgcatatggttattttttctgaactgtttaaaagtaagttgtagacaatgctccattacctgtaaatacttgagtgtatttcgtaaaaacaaggatactgacttgtgtaattacagtacagttatctaatgaggaaattaagatagatatagtactataatctacaacatttatccaaattttacttagtgtcccaatgatgtcttttatagcaaaacaaaaggtttttcctctggtccacgttccaatccaggatcacatgttgcattgagttgtcacgtctgcatagtctcctttcacctgaaagagttcatcatcagtctttgtcttttttgacttaatactttccaagagtacagacagtttattttgggtagtcctttgacttggatttgtttatcgtttcctcatgagtacactgatgttatgtatttggcaggaatatcacagaaatgatgttgtgtccttctcagtgcctcataacaagggacacaatatttctgtgtcatcattggtgatgttaacgtggatcatctggtgaaagtggtgtttgccagctatctccaaactttgcccacttataattgggttatttatcattttattattgattttaagagtgatatatacatatatatgtgatatattttttctctatgtaagttctttatcagatatgatttgcaaatgctttttcccatcctgtaggttgtcttttcactctctcgatggtatcacttgcagcacgaaagtttttaatttggatgaagtacaacttacctatttatttcttttgtcatttgtgcctttggctcttgtcttagaagctttgtctagcctgaggtgttctatggtttttatgttttcttccaagagttttatagttttaacttttatatgtttaggtttttgacccattttgaattcatttttggatgtggtgtaaggtaggggttccaactttattctttaacgtggatatgtggttgtcctagcaccatttgttgaaaagactattcttgaaaagactattctttccctgattgagtggtcttggtactctttttggaaatcagttgaccacaaatgtaggagtttatttctggactctcaattccgttccattgttttgtatgtctattcttaatgcaagcaccatgctttctctattactgtagctttgtagtaagttgtaaaatcaggaaatgtgagccctccaacttcgttcttgtttttcaagattgttttggttattgtggatgcttgcatttccacgtaaatattaggatcagcttatcaatttctgtagaaaaatggcagctaggactttgacagggaatacgttggatatctagatcaatttggagagcattgccatattaaccatcctggcttccaatccatgaacacaagatggatttctatttacttaggttttcttgaatttctttcaatgatagttttgtagtttcagtgtacaaattttgtacttcttttattaagtacatacctaaggattttattattttgatactggagtttttttaatttcacttttggatgttcactgataatgtattagaaatacacttgagttgtaaatgttgattttgtaacttacaaccttgctgaactcatgtattagctctaatgggttttattgaattccttagggttttctatgtgcaatatcatgtcatctgcagatacagttttagtttttcctttccaacctagatgcctttattttccttgcctaattatcctagctagactctccagcacaatgtggaatagaaatagggagagtagacatctttattttgttcctgtttttaagaagaaagaagttagtctttcatcattaagtatgatgttagcagcagatttttcatagataacctttatcagattgaggaagttccctttattcatagttcatttgtatcatgtaatttgagaaagtcttaattcattgtgtctcagacaatcattgtcacaacatatttaaagattaggctaggctgggtgtggtggctgatgcctgtaatcctagcactttgggaggctgaggaaggaggattgcttgagtgggcagttcgagaccagcctgggcgacatggtaaaaccccgtctctgcaaaaagtacaaaaaaaaaaaaaattagctcagcatggtgacatacacctgtagtcccagctactcaggaggcagaagtgggaggatcacctgagcctgggaggttgaggctgtggtgagtggtgatcatgccactgcactccagcctgggcgacagagcaagatcctgtcaaaaaaaaaaaaaaaaaagaatagaataaatagcagactagggaatcattggatcataaccttcaatttacagtagaaaaaatgctgccaaatataaattggtgtaaaagtaattgcagtttttgccattaaaaacctaatattaagcagaacatccttttactactacaaaatgtgcccttttgaccctcattcagtactcagtgcctttttttaaaaatacattttaataatttttttattgatgtgtaacgtataaacaagtttgtaatgtgcacttaagtgtacagcttgataaattttgatacatatatacattcttgtacctgcctcccagatcagcaccccagaagttgctttgtgccccttcacagtcattaaactccctccagtgataactgttttgatttttaccaccaatggttagtttcacctgttcttgacctacaaataaacagaatcatgtagtttgtacccttgtttctcacctctttcccttaaaataatattcatagctgggcacggtggcccacacctgtaatcccagcactttgggaggccaaggcaggaggatcggttgatcccaggagttcaagaccagcctgggcaacacagggagaccctcgtctctacaaaaaataaaaaaattagctgggcgtggtggtgtgcgcctccagtcccagctacttgggaggatgaggtgggaggattgcttgagcctgtgaggtcgagactgcagtgaaccatgatcacgccactgcactccaggctaggtgacagagtgataccccatctcaaaaacaagaaacaaaatgaaatccaactgtgaagtatatatcagttcattctttctctgtgtagcattccgttgtgttccaatttatctgttcttctattaatgaagacttggattgtttctgtttgggggttattatgaagaaaatgactatgaacattcttatatatgccttttggtgaacatatatattgatttctattgagtatatatctaggagtggattactggattatagggtaggtttatcttcagctttggttgttgatactgccaagagttttccaaagtggtcatgtcaatttacactcccactagcaatgtatgagagtcccagttgttccgtattcttaagaacagttgatatcatcttttattttttttctgttgagacagagtcttgctcttttgcccagctggagtgcagtggcgcagtcttggctcactgcaacctctgcctcccggtctcaagcaatcttcctacctcagtctcctgagtagctgggactacaggtgtgtgccaccacacctggctaatttaaaaaaaaaaaaaaattgtagaaacggggtttcggccacgttgcccaggttggtctcgaactcctggcctcaagcagtcttcccgcttcagtctcccaaagtgctaagattacaggcatgagccactacacctggctgataccgtcttttaaatcttagttgttctgtgagtgcataccatatgtctcttaagaagcctgacgattgggttatccagctttcaaagattagaagaaaaggtaagatgggttagttagaaaaaagagcattttaatggtttatggaaattatcctgaaatgtacagtattcctccttgacatcttaagagagaattgtgagtaaaaatgttctaatgagtcaagatgacttgtatccaaataaaaactgcacaagtctaggaagtggcccacgtggcccagtagaatttgtgagaaagatttatgggtcaatattaagcttgttctgtgtcagcagaatgatgtggccaccttatgcgtttcctcctcaccattccccttatacaacaccctgtatcttactgagaactagattgtctgtactttgagaggcaatagtccccctatccttagcattgattagatcccctctgaacactggtcttggggccagacttcaagaataatacaagaggctgggtgcgggggctcatgcctcccaacactttcggaggccgtggtgggagaatcatttgagtccaggagtttgagaccaagctgggcaacatagtgagaccccgtctacaaaaaatacaaaaattagccgggcttggtgatgggtgcctgtagtctcagctgcttgagaggctgaggtgggaggattgcttgagctcaggaggctggctgaggctgcattgagctgtgatcacatcactgcactccagcctgggcgacagagcgagaccctgtctttaaaaaaaaaaagaaaaagagtaacacagggacgtcatctgaagaattacctgctagtagagtaactcacacgtcctggggaaaacagtgatgggacagaaaggaaagacttatagggacatggtaaaattatgtgcacttctaatggggtgttaagtagaaaaatggttaattctaagcaaactgtggatggaacccacatgaaagaagtctttggttcagtaaaagggaaatatttctcattaagatcttccaagaatgagctgtctttgggaggtaatgagttctctgttgctggaggtactcaagcatcaattggtcaaccagttggtggagatactatacagaggggattcaggtatcacattggtagttgccctagatttgataaccactaaagtaccacgtcaaatcaaggaggggatcgattgttccatgacttgtaaaagtttggtttatatttaagtacagtttaataaagctaagttaaaaacaaggaatgagagcagttctgagttggcaacgtatttgtgacacttgctgttctagatttttctctttggtcaaagagatgataaccaatacagcaggcagtacggtggagctggagggagagaccgatggagacaccttggaggtgagtcatggacgatctagaatatggaaaacattgattgtgtgttcgatgcttcaagaaaatgtcccatctttctataaaaatcctctgttgagtatgttttatgaacctgccagccatcactgcatggttcccagagataatgttgaatgtgtctccagagaagaatctcatttctttgggattctctcagttagaatgcttaagaaaaatttggccatggactagactaaaatttccttttgtgaacaacctatgaaagttttctctaggctaattagtaatgtctgtgagactacaagagaattagttggccaactgagagcagacgttttatgcttaaaatgactttagttatagctatgtgcatatactatatgaaatataacaactttaaaatcattttaaaaagtaggctcatcagctctttttaacagcacagttatagtccacagttgctaaaccattgtacaggtgtttaaatcttgcccagttattcagatttgccactcactcaggttcttccagtgattacaatttaatgagattttactgtactttcaggttagactgaaaggaattccttaatgtttctttcagaaaatatcaaagggattcattttaataattgagttaactactagaattcttaggtcaggaccagagtttgttgtagaaatgaactgagcaatggtgctttgagggcagcaggtgtgggaatcggagggaggtgtgaggtaaaagtcttctatggagcaggctgattgccagttacatcagacactgatggagatcctttactaaccatgtttttttttttttttttttttttttttggaaacagagtctcacgctgttgctgaggctggagtggagtgcagtggcgcaatctcgccttactgcaacctctgcctcctgggttcaagcgattctcctgcctcagcctcccatgtagctgggactacaggcacccgccaccacgcctggctaatttttgtattttatttatttagagatggagtcttcctctgttacccaggctggagtgcagtggcgtgatcttggctcactgcaacctccacctaccaggtttaagcgattctcctgcctcagcatcctgagtagctgggaccacaggcacgtgccaccacgcctggctaattttttgtatttttagtagaaacgggatttcaccatgttggccaggctggtctcgaattcctgacctcaggtggtctactcgcctcggcctcccaaagtgctgggattacaggcatgagccaccacgcctggcctaatttttgtatttttagtagagatggggtttcgctatgttggccatgctggtctcaggtggtcctcctgcctgggcctcccaaagtgctaggattacaagcatgagccacagtgtccagccaaccctttagtaatcttaattgtcatgaacatccctagaagtagatgggaaaggacacccacatacccgccgactattccgtgtataagctgcacttctgtaagtagaagcagtggagcatgcaaaataacagaaaaaattgattgctgcctctctgctttaaataagtgttgctcagcgtacagtcacatttgttttaatcatcgagaagaatcaaatgcatctgtatgtgacagcttttgatgggaagatgggggaacaaaatagtaatgctaattgtaaatcaagtttttgtactaggtgtttactactagatccgtatgcctgaaagagtggggaagccccagcatatttactttttgtattaagataatgttaattatattgaccttcaattcctttctgggttattgaaagatatttgtttcctgacaacttgataagggattatgcaggaagacacctagttgggttattcaacatgcttagaagcagttttaaattgcagcgttaaaatggggaagaatttccaaaaggtgagccaattatatgcaaaccatatttttaattttcttggattccatttcataaagtcatactatgaacaggtgaacaatggagaattctgcccctttaaagtcatttaatgaaaagggcctaagctaagcactgtgacttgcctgacagtcaaataatgttatttatattttttttagttgctagacaactctgggggccttagagggcttctccgctacaagttgtatgcttttttgtccttttgtttttccttcttcagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggcaagtccaggcgggccttccgcatttcgggtgccgtctccacaccccagatcccatacccaccgctcatggtgtggaggagttaagggcaaaagcattgtgttaccacaaaacctgtcattctcttgtaataggggtgatcttttttttttttttttttttgaaacggagtctcgctctattgcccaggctggagtgcagtggcatgatcttggctcactgcaacctctgcctcccaggttcaagcaattctcatggctcaacctgtagctgggattacaccatgcccagctgatttttttgtatttttagtagagacggggtttcaccatgttggtcaggttggtctcgaactcctgacctcaagtgatctgcccgccttggcctcccaaagtgctgggattacaggcatgagccaccgcgcccggccagggtgatgtgcttttgttttgtgtattatagattgagaaaatggaagaactacacttcagaggcacgtggattgcagaggatcatattttaaaagaaaacttttgttgtgtttccacccattggctaggtctaaagttttacattttttgcgtagttgtttgcaaatatatatacatttttgagatgaagtctcactctgtcactcaggcaggagtgcagtggcagatctcggctcactgcagtctccacctcctgggctcaagtgatcttcccacttcagccgcctgaggagctgggactacagacacacgtcaccatgcctgtctaatttttgagtgcaaatataatttttaaatattactgggttattttaaatttacattgtagcagttgaaaatggctatgatttgttcagatgcatcattgtggaaaattacatgcagataaaaaaaatcagatttttgcagtacagaattttttttaacatcctacccttcaccctcacacatggattttggactgtttttctaccatgagtactgcttattcatttctttgactttttttaattttaagaaatgtttgtttctagccgggcattgtagctcaagcctgtaatcccagcactttgggaggctgaggcgggcagctcacttgaggtcaagagttcaagaccagcctggggaacatggtgaaacctcgtctctgttaaaaatacaaaacttaggtgggtgggcatggtggcgcacacctgtagtcccagctactctggaggctgaggcacgagaatcgcttgaaccccggaggcagaggctacagtgagccgagactgtgccactgcactccagcctgggtgacagagtgagaccctgtctcaaaaaaaaaaaaaaaagtttaaatttataccccaacaaaatgagcattgcaatgttgactgcaaagtgtttctgtagagaagctacatacacagttggaattaatcattccgggatccacaggtgtgtcagaccacagctgtaggattgccttcagtgtcgagtgctgaagaataatgtgtaaacacccatgtatctgggtgattgctgatatattggggatgagttttaagggatttctgccagctgtaagacccttcattcatccattcatgtatttgttgattttcagtgggatagcatgttatgatacgtgaattatgagacaggacctgaaatgaactatttccatttcttcatttcaccaataagaaaatcaagactgaggaagattaaatgactttcccaaggatgcttagaaacaagactaggatccgagtctcttgagttcctcatccagcatccagtctcttttctcatgatggataaggtgttgcagttgtatctatttggggaaatttctggcatgtcccatctccttcatttggtagcaatagctgttctagctttttgttgctgatcagtagttcctgggattttaagagctagaagggacctttagagactgttttgttcaactccctaaatttataggctgaacttatgatgataggtactttctctgtgtcagactctgggctggcactggggaccgaaaggtgattaggatagtgtccttttcccagggttctgctggttcggtggcaaatgcagatgctttgcctctgagtgaaagtgccaagtgccatgatagaggagtacacagagtgtttttagaacgcagaagaggaatgaattactctccttagtgagttgtggcaagtttgaaaaaatagatcaactttgagctgcactttgagggatgagtaagaatttgtttagcggaaaaggaggcctatgctgatggaaaaacagagctgttaaaacacaaagtatattcagagaacaacagattgtctgatatgacttgaatgtaggatgcagggcagtgagatgctcttgaaatgaggccaaaaaaaaattttttaaggcttagcctgaactgatctttgaaagtccttgtatgtgacattaaatagcatggtctctatgtggaatttatgtggggaagggatgtggtgaagtgtgtgttttaagaagaggtagtataatggccaaggttggggaatggattaaaaaggccagaggctggggctgggtggcccattaggtggctgctgttgtggtctggggcgactctgtagaataagacgagagggcagctgagggcagaaccttccagaacaccactcttcatgggaggcagaggaagaggggctgttgagagaggtaaagaatggttggtgggttcaggcccgaaaaataacagtagtaacaatagcagtcattcattgaatactcaccacacaccagctactccactaagtgcttaatgaaatggacatgccttggcccctggcagccctgcatggctgtaggcttatcctctattgtacagatgggaagttgaatagtttcatggaagccagagaaaagaaagtttccagaaagaagggatgggcagcagtggggcaggtcctggtgaggtgagatgtggttctagagtccctgggatttggcaggtgaccctggctctgtttttcccaataggtattctcagcctctgcacgaggagatagccctgcacaagtaccttaagcaccgcaatatcgttcagtacctgggctctgtttcagagaacggctacattaagatatttatggagcaggtgcctggaggtgagtagtcgctgtcttctggtctcacattctgaaaatcactacgacgtggatgtcatttgttgtcctgccatttacaaaatgacagacccctaagccaggcctgtagggcgcctgtagtcccagttacttgggaggccgagatgggaagatcacttgagcccatgaggtcaaggctgcagtgagccatgatcacagcactgcactccagcctgggcgacagagcaaaacccatcactctttttaaaaaaaaaaaaaaaaaaaaaaaaaaaaaaaaaaaaaaaaaaaaaagcaacagaccctttagatgttggaaagttggatactttccaaatgtcatataagcagtctatttctggtttgttgatgcagtttgttcaacccacaaatattcattgactgtctatggagaaaacatagtctttggccttgaggccttcacagtctaggagtttaaaggtgggtttggacaagggtgcagaagagggaacatagatgttaaaagtgacagtgcaaaatagcattttgataatgaaatcaagcatcagtgttttatccacaaaaatccctgaatgcaagagatagggcacaggaggggagttcctgggatctggacccagaccatctagtctgagtccgttcctccatccacaagctgtgtgacttcaggcaaattgttatacctctctgtgccctcagttttctgattgaataaatgaactgtaaaattggagtaataatgactctgataattggagtaataattattggagtaacaattaacgctgtctcagtgggctgttgggtggattctgtctggcagagaacaagagctcagtaagtgctcattgaaataatgaatcaaactctttaattaaataatagttatctgaatacagatgttaaaacttcagttagaaatcttcattcattcattcaactgacagttattaagagtctgctattacaggaagagtcttaagtatatttattaagagccaggcagtcagccaggcacagtggtcacgcctgtaatcccagcactttgggaggccaaggcaggtggatcacttgaggccaggaattcgagaccagcctggccaacatggagaaaccccctctctactaaaaatacaaaaaattagccaggtgtggtggcgtgcgcctgtagtcccagctactccggaggctgaggcacaagaatcgcttaaaaccaggaggaggaggttgcagtgagccaagatcataccactccactccattctaggttacacagtgagactccgtcttcaaaaaaaaaaaaaaaaaaaaaaaaaaaaagagccaggcagtgggctagattttcagggttatgttagaataaataaagtagtttgtctttcccttaagttggtcatagtctatcagaaaactcgtccattgctgctttttctttttttttttgagatggagtctctctgtctgttgcccaggctggagtgcagtggtacgatattggctcactgatggcaacctctgcctcctgggttcaagcaattctctctgcctcagcctctcaagtagctaggattacaagtgcgtgccaccacgcctggctaatttttgtatttttagtagagatggggttttgccacgttgaccaggctggtcttgaactcctgacctcaggtgatctgcccgcctcggcctcccaaagtgctgggattacaggcgtgagccaccgtgcccggccccttactcttcacgttagttgataaccccatccccggcgttaggtttaagggtatcaacagaaatagagacagatgtgttcatccccttttatagatggggaaaccaaggtagatcaaggtcccataacactgtgtaagtgggaatctgagaccagccgatgtctgagggcccgttcctgccaatggacaggacatcccgcagttcacatgatgtccttcgagacgtggtcacagtgtccttaagggagcttttcttttggcccaaatgttcagtgtttaatagcgtaattgggggaagtggttgttgatcaagacagtcctgccctgagacttgccactgtggctttctcacattgaggacagagagacccaacttcctccagtcctagtccttgtcaccctaaagggcccctcactgtggacctgtccacctctgattacagacaaggtataaaacgtggctttaacccaagcagaatgactgagacagacctgctgtaaacaagtgtcatgggacctgagttatctacgccagcaggccatgcccctcaagttgagagagcattatttcgctctcctcctaacttcatgtagctgaacagagctaaacccacaattggccccactgaatttcagggggcacaaggggttcatgttcaccctgtgcctctggttaggttcatgtgctcaattgcttccagtccattccctggctgtagctacagaggggaggaaacatgttgcatttagcccagatccgatggtgttggtgtaagcacttaggttaggttagaaacctcacctcactttatttccctgaacttttattgaaactttctcttcctgataagttttttgctgtgactgtctctaggaagcctttctgctcttctgcgatccaaatgggggccgatgaaggaaccgacaatcaagttttacaccaaacagatcctggagggccttaagtatcttcatgaaaaccagatcgtgcacagagacataaaggtacttgcttttttaagctgacgaggttgcctttgctcgtatcagatcatgagagctgtcgatggtgtctgctgagtgactggctgacagaggggtatgatttagcacaaccgtccccaaaatgcaaagtctagttttcctagagacttgtgacggtttcccaaggtccagatctgtttcatatgagttcgtttcagcctgtcttttaagcacttgatgatgttattttccgaagggcgataatgttctggtgaacacctacagcggagtggtgaaaatctccgattttggaacctcgaaacgtcttgcgggtgtgaacccctgcacagagacttttactggtaagtggaccaaagcttggcacagggtgcccatcccagagttacgctttctgcacaagctgcggttgttcagccgttacttagtgagcaccttttctgagcagagtgagcaattgatacttgaagtagacagtggattgtccccaacttcaaattgttttaactttgtcatagtgatgcacctagccagctacttgtggcaacaagattgccctactttcttctttgtcatccaaaagttgggtagatggagtgctctgctgaggttctgaggttttcttttcttttttttctttttttctttcttttttttttttttttttttttgagacggggtctcactctgtcgcctaggctggagtgcagtggcacgatctcggctcactgctacctccacctcctgggttcaaatgattctcgtctctcagcctcccaagtagcttggattataggcgcgccccctaccacacctaattttctattttcagtagagacgaggtttcaccatgttgaccaggctggtctcgaactcctgacctcaagtgattcgcccacctcagcctcccaaagtgctgggatagattacagatgtgagccaccgcgcctggcctctgctgaggctttctgaaggtcactcaaccaatcagcaagatggcagcacatctctttaaagttaatagcacattatctgaaatcgtgggtaatgctgaataacagtattcctcagacaactgattaagacattttattggtctgtcataaaaatagcctgttactgtagtgaattctggtaccttgtgttttgatatgattgtgtttccaagagaggctaattcttcctggggaatatggtattctaagtgattttgaggaattggattttcttgtccatgtgtcagtaatggaataacttgagcattgagagggactgggttcaaagggtggtatacaattaccagctagtttcacagttgtaagatcaataagtagaatgatggtcaaaagctacttgtggctattggaaattcctgcttaaacctgactaataacaagaactttgatccttggaaagaagtactgatttttgaataagtaaaggtttatagtcccccaaggagtaacgtaaagatcacaaagatcttgcttgatggaattatgaaacagctggggcctggtatagtggctgacacctgtaatcccagcactttaaaaggccaagatgggaggatcacttgaggccagcagtgcaagaccagcgtggtcaacatagtgagaccccatttcttaaaagaaaaaaaaaaaaacagctttcataggctgggcactttgggagattgaggcaggaggatctcacttgagctcaggagttcaagaccagcctgcgcaacatagggagaaccccatctctacaaaaaataaataattattattattacatattatatttatatattatatgttatatataatataatacataatgattatatataatatatgtatataacatatattatatagtaattattagctgggtgtggtggtgtgcgcctatggtcccagctactagtgaggctgaggtgggaggatcgcttgagcccaggaggttgaggctgcagtgagctgtgattgtgccactgcactccagcctgggtggcagagtgagactctgtctcaaaaaaaaaaaaaaaaaaaaaagaaaaaattagctcttaaaataatatagctctgaaataagctataaaagacaggtgactgttctctatctctgcagtcaccaaagctgtagggtggacagcttgggtcttatttttggtaaataatgtgtcagctttgaaagactttttgtcaatgagagagttgtcgcgtgtcagccactggacacccacagtggagacacattcaccatctaaagagaattttaatacatcacaaaatgacttctcacttgtaacacaaggggaggtacatgtgcctgaaaatgggaaaatactataccagggacactatcagaatctcccaaagaaagagtgcattgaattttcattcattgtttctggtataaatatacgtatacatctgtcaatgtgtgtatatgaatatgtgtgtatgactagcacttcattttcttttagcattttactaccctaattgaaaatgacttgtatcctcctctttggaagccaccaattagcttggcaatacatagcaagaggggctctgatatgacaaggagttatttgaagacataaaacccccaacaatttatctcataattagcttccctgaggaggaaacaaactcacaaagaaacacatgtataattcatccttgcatatcacacttcccaagtaattggcttggggaggcacggattttgcattgcaaaagaatgcaggggtgtttgggggataataaggaaggggtctcattttggttaggaaattcccccgcatataattgctctttgcaaaacagagcagttctgtaaggaaatctcagctggttggtgcagaactctgggtctgtggttgctcagcctggcaggagagccagagggtttcagtcaacttcctggcctggagccctccctccctgtgttcctctgaagggtttgccccacacataggaacctgcgagaacaggaggaagggctgttatagccagggtcagccctgccttttttttttttttttttttagcagccttatcgaggtatagctgacatatcatcaaagcacccattagaagtactcaattctttggttttcagtaaatttactgagttgctcagccatcaccacgatccagtgtctggacctagcagaccccgtgccccttggtactcatccccattcccactccagccccagctcatcactcatctgctttgttgtgtttgtgtggctttgcccgttgtggatattcatatgcttggaatgaatacaatatgtggggttttgcatgtagcttcttgcacgttgagtcctgtttttgcagttcctccatgcagtggtgtgtatgggtacttcgttgttgttcatggctgaatggcattccattgtgtggagaaccacattttgttcatccgtttaccagttaacagtcatttgggattgtttctactttttggccactgcgaataatgatgctgtgaacattcacatacaaagcgtgtgtgaacatgtgttttcagccttcttgggtagatacctagagggagaactcgggacaggaagtctgttctcgtctggctgcaaacatcgttggttcaaatcctggcccaaccacttgctagctgtgtgaccttgggcatattacttaacctccatgtgcctcagtttcttcgtaagtaaaatagaaatgctcgttgtacctactcatagggtttttatgagggtaaagtgagttactgatgaagtgctttgactggtccctggcacatagcaagtgcaattgaagtgtttgctaattaaatactcgcttgtacttagaagtcatgggttattagagctggaaggagcctttgagagaactgagtttgtgtgtgtaactaacgtgttgaacccattggactcaaagggtgtaatcacaaaagccactggatttttctctcccacttttcatcctgcctggggcgggagttctttcctttgacttttccagccacccttacataacagagaaagtcataatgacacttgaaggagcgcacacagtctgaattcaggaattaaaaaggactcatcgcttgaagccgggaggcggaggttgcatgagccgattgtgccactgcactccagcctgggtgacagagcaagaccctgtctcaaaaaaaaagattcaggctgatactgatcaacgctctggtcctcattcaaaagtcagacccctctcccgtctccctgcaggcagcgacctgtggtcaggagctgggtgttgtctttttctccctaatcaccagctgcaggaaggagaggacaggggcagggaaagttgttacttgactagcactgttggaagctggctttgcgtgctgtgggcctggctgatgtttagttatcttccctcgctggctccctctggatgtaactcctgtgtcgtgggcaggggcctgtcctttggctgacagccccctcctcccagttatttaccccttacatcacctcctccttccatctctttctgttgagggattcagatcgtggaggactgcgtttgagcaggaattccttttcttttttctttatttttttattgggcagcccctggaaccagaataggttctgagagagactcccaggattccttttaagaagaccatatgctgggcacgcctgtaatcccagctctctgggaggctgaggtgggaggatcgcttgagcccaggagtttgagaccagcctggccaacatagtgaggccccgtctttaccaaaaatataaaaatcagctgggtgtggtggtgcgcacttgtagtctcagctactcgggaggctgaggtgagagaatcacttgagcccaggagaatgaggctgcagtgagtcataattgtgccactgcactccagcctgggcgacagaatgagaccctgtcaatcagtcaatcaatcaaataaataatacaaataaaagataaaccctaaggcagtatttctgtaatagggtcccccatctggtgtccagagttcaagcagcttcagcccactgttgagagggtgtggcagtatccccacaccttacagccccctgtctgctgctggaagttaacctttgctcacttgggtgccagtccactgtgtaatttacctacaggaacacatacacatggagctgagtcgctcagtgaagcccccttcaaaggctttgggttaggaacaagtggcgccacctttccaccaggcttatcccttggtcaggtcaactagggtagtcccctggactatgggaaaatcgtaccttacttttcttttctgtacttgattaatatgaaatcttgaaatttaggctctaacggtatctccaagggcctgtggaagatgtgatgatcataagttggtattgagtggcttgagttgccctgggcccacgcccttttggggacagtcctgccccaaatcctgtaacttgggagagggtaggcagcccagcatagctctctctaaagaagctgtctcagcaccacccccctaaactactctgtcaactctctcagccccttgatcagattagaaggtccctgggcctcggttataaacttgtgtcttctgctgtgtgtcttctttgctggtaatctgaaaatcctattggacaattctccaggagtccccagtggattttgtgccctaggggggctgagtcagtgcctgtgggtctcttggtcaccttgttctgaactctgcaccactgcactggtgtaggtacctaagagccgtagtgggctgtgaccagtgaccagtgtggtagggcataccttggaggaaatataggttagggagcatatggggccccaagagagccagatttttgtttgtttgtttgttttgttgaaatggagtcttactctgtcgcccaggctggagtgcagtggcgcgttcatggctcagtacaacctccaccacccgggttcaaacgattctcctgcctcagcctcccaagtagctgggaccacaggcacacgccaccatgcccggctaatttttgtatttttagtagagacggggtttcaccatgttggccaggctggtcttgaactcctgacctcaagccatccacctgcttcggcctcccaaagtgctgagattcaggtgtgagccaccgtgcctggcctatgagagccagattgaaggaaacccaattttccaggatttgtgcgtgattcagatgccccacaatgccatcttcacttggttttcttgacagaatccagcctttgggttagctgatgtacacacccaacatgcatcctgccagggagtgttcccttgagtatctgaaatagttgtgtgcatttatctctctctgttagctgttctgagagtggatggttaccttgtgaatacagtagtgaataaaatggagcacccagttttccattagtgccctgtaccttccagttacatggaaagatgctccaatatggctttggaaatccttacacgtgctactcttattcaggcagctttttttttccagcagcgcttcttcttgatgtagtgtatggatgagtgatgtcatggtgtgtagttctgaacttgaaggtagaagatatgggttctagcctaagcgaatcctttagcctctctgaacctcagttgcctcctgtgtaaagtaggaataatggtagatagtgcttcctctgcctaaccttccagagtcgtttgagtcagatggacaaggctatgtggagacaattggtaagccatcaagtgctcaccaggagtcagatttgtggcaggcagcctccaaaatgacccccaatgatccctacctcctgatagtcacacccttgcgtagttccctcccgttgaatgtggactggacttagcaacttgcttctgatgaataggaagaagtgggagtgatggtgtgtgacctggacactaggtcataaaaggcagtgtgccattcctctttctctcggatcagtctctctgagggaagccatgtctcaaaccagtcctatggaggatcccatgtaatgaaaaactgaagccccccactagctctatccttagtgagcttggaaactgatcctccagccccagtccagccttcagatgactgtagccccagctgacatctggactgcaacttcctgggagaccctgagccaggtccacccagctagttagttgctgctggatttcaacccttagaaacgctgtaagacctaactatttgttgtttgagttgatagatttgggggatcatttcttaaacagcagtaaataactaatatgaatgtcattattaaatccttgcctttagaaagagtgctgttcaccatggctccatatttttaaaaatctgcaaatttatttttaacttttgtgggtatatagcaggtatatatatttatggggtatatagactattttgatacaggcacacaatgtgtaataatcacatcagggtaaataaggtatttattacctcaggcatttatcctttgtgttacaaacaatccagttatgctcttttcagttttttaaaatgtacagtttttttttttttttttttttttttttttttcccctgagacaaggtctcactcccatctgcccaggctggagggcagtggcgtgatctcagttcactgcagccccaacttcatgggctcaggtgatcctcccacctcagccttccaagtagctgagactacatgtgcacaccaccaaccctgactaattttttgtacttttttagtagagatggggtttcgctgtgttgcccaggctggtctcaaactcctgggctcaagtgatccacccacctcggcctcccaaagtgctgggattgcaggcatgagccaccatgcccagccaaaatgtattgactatggtcaccctgttgtgctatcaaatactagatcttattcattctttctatttttttttgtacccactaaccatccccaccttcccccagtccccactgcccttcccagcctctggtaaccatccttctactctccatgtccctgagttcaattgttttgatttttagctctcacaaataagtgagagcatgcaatgtttctctttctatgcctgacttatttcgctttatataatgatctccagttccatccatgttgttgcagatgacaggatctcattcttttaatggctgaatggtactccattgtgtatatgtaccacattttctttatccattcatctgttgatggacacttaggttgcctccaaatcttggctattgtgaactgtgcttcaacaaacatgcgggtgcagatatctctttgatatactgatttcctttcttttgggtatatacctaggaatggggttgccggatcctatgataactctatttttaggtttttgaggaacctccaaactgttctccatagtggttgtactaatttacactcccaccaacagtgtatgagggttcccttttctccacatcctcgcccgcatttgttattgcctgtcttttggatatcagccattttaactgcagtgagatgctatctcactgtggttttgatttgcatttttctgatgattagggatgttgagcaccctttcatatgcctgttggccatttacaaatgtcttcttttgagaaatgtctattcagatgttttgcccatttttaaaaatctaattattagatgttttcttatagagttgtgtgagctccttatatattctggtgactaatctcctggcagaggggtattttgcaaatattttctcccattctgtgggttgtctcttcactttgctgactgttgcctttgctgtgcaaaatctccaaatttagaattaagcagactaaataggcttcaattaggaaataattgtaccaggatggacagttatttgaccagagccaattagccattgatgtttggtttagcgtttcttttctactgctggatacatctataaatgtattctcttgctctttgaagaaataaatttagtgattatattagtcagggtccaggcagaaaaacaaaaataaccccagttatttccatggagagaatttaatagaaataactgtttgctggttaccaaaaaccagaaaggcagaaagggaggccctgaggtatcaggaagcctgtacccctggggcttgggggtcaaatgggagggtgagattagaacttgttcggagggagtgtcaccaggctggagcaggtacctctgaggggcaagatgaggctggttctggaagtacggggtgacacacagcgggagactggggccgactgagggtccaacgccaagcttagggccacagcaagcacacagcaggtctccgcttcctcccgcatccttccagggtctctctttagcgccacctggttgcggagcctaatggggagctgcaggcgaagcagagtcccagactcagcatcacagagcagagctgagagagggtagcttcataagcagcacagtatcggatccttcctcaattagggattcgttagaaggcacattccctgccaagacctctccctctgttacagcagcaagagcccataggggatattgtgtcatcggatgttcccttcttggggctctgggatttcctaacagggcatcaagtgtaatgcgctgccatgttgcccaactctgcaactcactgaacatttccccgccagggcatcagctctggagaccaaagccatcatttgttcctcatcgatctgttgtgctcactgatacaacccaattcatatttaagtttatatttaagtcacttgtaattgaatacaattaaaacttaaaaatgcatttcttcagtctcactagctacatttcaagggcccaacagtcaaatatatgaggctagtgactaccatatttaaccacacaggatagaacgttgccatcagcgcaggacattccatccgtcacagctgcccctagagtatttaaagaatgctaataagacataggatcttccagagggggacacaggaggtagtttctccaaactttctttatagccagtgcgccctttgctttcctttttttttttttttttttttttggagactgagtctcgctctgtcgccaaggctggagtgcagtaatgcgatctcagctcactgcgagccaggttcaagggattctcctgcctcagcctcccgagtagctgggattacaggcacccaccaccatgtctggctaatttttgcatttttatatttttagtagagacggggtttcgccatgttggccaggctggtctcgaacttctgacctcaggtgatccgcctgcctcggcctcccaaagtgctgggattacaggcgttagccaccatgcccggccctgctttcattgattaaacctttagttgtgtaatcctcagataggcctttgaatttctctgggtttcagtgttctattcatgcgtggccaaggtcagagctctgactttgctgtctttttctaaatttctttgccagcccccaggagctgctgtcactttcacacacgtcccctttgcacaggctgagtttcaaggaaaacgaaggatgttattcgcagagcccttgactgacctccccgtgtgctgtctcccacaagagcacgtccaaagccagagccctgggcccaccctgcttgccactgggcctgtgcccttgccattgcctccttaactattcccacaccctgccccgtgtcagacatcgcttgttccccggaccgctgtctatctcacacccatgatcccctttgtccagccctccagccttcgcagcaggaccctgcttccctgacagccccggctaccaacccagcaaagttacactttacccaggctgctccccaccaaggcctgagcctggcaggggtgctagaacccaggtgggactcctccagtggatgacttggggctgcagactccccagcagcctggctgaagccctctccgggctgctctcccatcccagattcttcctgattctgccttcctctccgctcccaggtgttgcacctgccatgtggtccgcagccggccctgcccaccctgctccctcccgctttgtccttcagagaccttctccccaataaatctctcatatgtctcatctcgtcttggcattttactcctcagaggcccaaatggacacagccatagtgtttcctgacccgaaccaggcagagagtcaaaccctattttattaatgctcttgcagccttctgtgtatttctctgtcctagcacctaccacattttgccattactgccaccgctgccagcattctgtctttgtctcctccactaggcacctccctaccatcaggctgtgtttctcacgttctggcttccctgtatttggcatgtactaatatgtgctgactgaattgcgccatttgtcctttgatgggccaggcagtcctctctccacgtggttagtattaaaggaaggcatgttgcatgcctctgctcaaagaaatatgcagtcaggccaggagcagtggctcacgcctataatcccagcactttgggaagctgaggcaggcacatcacctgaggtcagagagaccagcctggcccacatggtaaaacctcgtctctactaaaaatacaaaaattagccgggcatggtggtgtgtgcctctaatcccaactacttgggtggctatggcgtgagaatcgcttgaacccgggaggcggagttcgcggtgagccgagatcacgccactgcactccagcctgggcgacagagcaagactctgtctcaaaaaaaaaaaagaagcaaccatattatttatgcatgggacaagactccatctgccatttgtgaagccattcatttcacagttagtggtgggttttttgttttgttttgtttttgagacaaggtcttgttacattgtccaggctggtctccaacacctgggctcaggtgatcctcctgcctcagcctcccgagtagctgggactacaggccacttagtttctgagcaatatggtacccacagcctgtttgtttgttttccaaataggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtaagtcatgcttcgtgattgaggttgggcgtggttgggaagtagaattaaaaacaaagtctcctcccaatccagaaaacctctccacaaaggtaggagagaaggaaacagttttattattggataagcattaaaccagaatgcgaggtgcatcacaggcaatccactgagactgcaaagatggaaagcaatctcactgtttcatagagccgagcagacacaacccgtgacatctgtgttctcaagagaaaccgtaactagtcctcaagtaagacaacttggtggtgccatttgtcacaaggagctcatcttagattcacctggtgattggggggaccattggtgttcactgtttggcttcatccaaaggaaaatataggccgggcgcggtggctcacgcctgtaatcccagcaatttgggaggccgagatgggtggatcacctgaggtcaggagttagacaccatcctgggcaacatggcaaaacctcgtctctgatacaaaaatcagctggacgtggtggcgcatgcctgtaatcccagctactcgggagactgaaacaggagaatcgcttgaatccaggaggcagaggttgcagtgagccgagattgcaccactgcagtcccgcctgggtgacagcaagacactacctcaaaaaaaaaaaaaaaaaaaaaaaaaaggaaaaacactaaacttctcatatctttaagacagtaggtagttttggagtgaagccaccatcaaagttagaaacctaccttcctatttctgggagagcagagttatgaaaacattaataaaagatgacaggtttaaaaaaaaaaaagaaaaaggaaactaggagatagaggccctatcttctttgatgattacatttcagagagatggcttccaggtccttgcaaaagacatttctggcaagagtcttatttagccgtttaaaagattcacgtatatctcagagacagagaaagaaccttaaagttataagttctctcaagtcaaggctctaagaaagctgggcagggtgggggagggtcctttccctttattttcaacagggagaatccagccccttagtttcccttcatgtttgctcttacagtgggtaaggctcaaaggccatgtgggatctgtgcctttgggggacaggtttctgactggcttctggagaggtgggagttgggctatcaggtaaatatatcccttatcattccaacaaccctccccgagctaacaggaagggcagcccatgtactggggccaacatagtgcagattgagcattgcgggtgggggttttaccgccgagcagccaagattgtggaaagggatgtccttccttgtgacctcacgggaagctgatgccaggacaccccggtgtacccaaggttgggtgtgcagcttctggcctcatgtatgcttagaaacatgtaaggggcttgatgtggtttggccatgtccccacccaaatctcatcttgaattgtagttcccataatccccacgtgttgtgggagggacccggtggggataattgaatcatgggggtgatttcccccatccagttcttctgatagtgagttctcacgagatctgatggttttataaggggcttccgcctttgctggttctcattctctctcctgccgccctgtgaagaggtgccttctgccatggatgtaaatgtcctgaggcctccccagccgcgtggaactgtgaatcaattaaacctctttataaattacccagtctcaggtatttcttcatagcagcatgagaacagactaatgcagagctctagccctaggatgccattaccagcactgaccttccatggggcactgccttgagacagcagggtcacaaaaggccaaatggccattgcttatggatgatgaggccgcagtgtgtggacacggccctgatagaacgcgattccagaggcgtcttcctggcttctctgccaaacacggtgccttcatggcctgtgtctgtgccaggctctctgcttccctcttgggcagaaggaacttggaggtgtgagtgcaggtttctgccggttgaggtgagggcagcatgttcaatgggtcccgagtgctgcctgcttgggtgccttggctgctctctccagcccggcgaggcccctgcagaagggtctcagagcttctcacctcctatcagctgcttgggttcagagcccaggccaagacctcaagtcgacaagagtcttctgatacctgcaatcccaagaggaccctcagctcctgggctggaagacagcaatgaccgtcctcagcactttgaccgtgtgcggtggaccctgttggggccgttgtagatctaacctgcagcttccatggcagcgttggaataaacagcagctggtgacgaggaaaacatgaggcccacctgagagccatggctggctgctttttgacctgctgctgacttccgggaaaccagggagagagctgaaggctgtgactggctcgattcctccgcagggcatgcctggctccccgcctcctcttgtttttgtttagcgaattcactgtacaaagtctctctttttttttttgacagagtctcactctgtcgcccagactggagtacagtggcacaatcttggctcactgcagcctctgcctcccgggttcaagcgattctcctgcctcagcctcccaagtagctgggattgtaggcatgggccaccatgcctggctattttgtatttttagtagagatggggtttcaccatgttggccagactggtctcaaactccagtgatccacctgcctccgcgtcccaaagtgctgggataacaggcgagagccaccgtgccccgcctgtatgaagggtttgaaaatgtactgacttttttggatggcatatgaagtcacttttcattgccaatgagaaagttattattaaataagtaatggcccctgtgttatttctgggatccttcattcctttagaaaactttcaagaaacttctgggcagtgtctgaaacaaaggacactctctttcccctgaagggactgttacagatttaactgtgtcacccaaaaatgatatatggaagtcctaacccccagtacctcagaatgtgaccttctttggaaatagggtctttacaaagaaaatcaaatgaaaatgggttctggaatgtgggccctaatccagtatgactggtgttttggactttttttttttcttttttaaatctttctttttattttttttaactagtcaagtgaaacagtgggagtggggaaggaacaaagaaatctctaactggttgtcatcaactagctgcaaacaccactgcactcggaccagcctggtgtcttttaaaaaggggggatatttgagccaggtgcattggctcacccctataatcccagcactttgggaggccgacgcaggaggatcacttgaggccaggagttcaagatcccccggggcaacatagcaagaccccgtgtctacaaaagatgaaaaaattagcccatgtggtggtgcacacctgtggtcccagctactcaggaacctgaagcaggaggatcccttgggcccaggagttggaggctgcagtgagctatgatcatgctactgtattccagcctgggtgaccaagtgagaccctgtctcaaaaagttggggggtgggggtggagatttggacacacatgctcagaagacaaagtacgattcccaggggaatgcctcggggaggcagaggagagaggggggtgcatctaggagccaaggagcgccagagaccgcccgcagaccacgagaagctagaagaggcaaaggcggggattccctgcatgtttcaggagtccctggccctaccaacgcttggatcttggacttccagcctccaggactgtgagacaataagcacctgttgtttcagccacccagtttgtggtattttgttacagtggccctaggagaccaatacaaggagcttttgggtcacggcaaagcacccttaaagaggacatcccagccgggtgtcattgtgctgcccacatttgctgttttcagagagccgggcagaggccaccctttccttttcatgttcttgcctgaatgttggtctttgtacccctagtgcctgtgaacagtgccagcttaacctccctaccgctcaggtgagaggagccacctgtgaggcaccctgcattgcagacctggcggtgggtgggatttcacccagcatttagtgttcttcgaatccgtaactcctgagctgggcagcctggccaggaggagcgctgtgttggaaacagcacatggccgtgactgccaggtcaagggccttggggacaggaagtggggaggcctggccctctacactctgcagcaccctgagctcactcggcggggattgtggaggctgagccagcccccaggagctctgaggagctgggaatgggcatgggtctggaggacagaacagcttccacgcctggattgttgggtgggcttggaaaagacacagggtggactgtgaaactgaaggtgacaactcctaaaaagatgagagggccaccctactgggaacagttatgaaggagggggctatataacatgtcacggaagcatgtccgtgtcacagcgagatgtggcagctcagaaccaactcttacttccctacaggtcacagggacagagagccattagttacctgtctatacattggcagcctcaaggttttgtctgcttgtggttttgagctggaggctgggaatctgggctgtggatgcagagggattgagaggtgttaaaggcatctcttggggaccctgtgcgtcagggaacaggtaacagatgcctttgagtatccttagaggacatgccgccctaggctgtggcccaagtcccatctcagttctctactgctatgtaccaaaccaccccaaaatttcagaagcttaaaacgatgactttttctcatgcctctttgagctgactgttggctcttctgtgggttttgcctgggctcactcacatggttgcagccaagtggtggtttgggggagcagggtggcctgagaggcccctccctcatggcagttccagctgggatggctggggcgtcctctccacggggtcgtacctcctgggcttcctctctgcatggtggtctcggggctttaagggtgactagcggagccacaagacctcttaaggcccgggccctgaaactctcaccatgtcacttctgtcactatctgttggtcaaagtcaagtcacaagatgccagtgagggggaaatggactccaccttggggtgggaggaacaagaacgtgacgttgcaagggggcatggattatgcctgtcctgggatgtcaggtgtacaggagctttggactgagacatggatacctgaattcacccaaggcctcactgacacatcggttacctctcccttaaatgcaggtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcaggtgaggcctccctggacagctggggcagcaccctggccacaagaatgctgggcgctgggcttctctgctgctcaggagggagagttctggctatccagagccctgggctgctcacgtcattcccatttttgtgaagagtgacggggcctgtgcagtaggtttggaggttgtcaaaatccaactaatacatgcacctcgatctcctgacagaggcccagggagtctctgggtgactgggctgccgtctgctggaagttgttccttcgggattgggaagagagtggggaggcaagaggtaccccagctggggttctgcgtcttcaccatgtgccagagcctggggcttcagttttggagcctggcttgtcatcgtgtgccaaccctgaccttgattaaaggatttgtcagggaggtttgcctgatgtggctgtcctgcaggccaccgaagtccagtgacaccttctggggcagtaagtcctaactggcaatgatgtaagagtggcccctgaaaaggaagcagtttgtcctcttttccctggtaccgatcggggtcagaagctgccagagtgagtggctcagcaacttgctccatgagggacccccaactgcatgcatctgagtagaaatacagcacctgtggcccgtcccccgcccaacccacatttctacaggatcctgggtgcctgggcggttcacctgggcttgaggggctgccagggactcagctccaccccgtccctctctgagtctccccattcggtgtctggctgtccccctacagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcaggtacacccgtattctgtctgtctgccgcgggcccgaaagggtgctggtagtcctccgccacagggcacctccctggtcccaaccagatggccactgaggggttttacttcccttctgcagggcagtagggcagctgagccgccccatcccggcaaggagggtgcttcgttcacttgctgtcccttcccctccctccctgtcctttcattccccacatgtgccctcccccacctctcctcttcccttctctctcccctctccttcgacacttcccctctctcctcttccccctctctctccccctcacccttgccccctctgtccctgcatcttccggccccctcctcctcctggcccctcctcctcccttcctccttttccttcctctctcttcctccttcccctgtccccctcaccttccctccctcacctctccttctgtgcttgcccccttccctccctccctccctcctccctgtctcctgggaggctcctttaccccgcctccccctccttctgctctccctcctgctgtgggggttgacagaacactgcatgtctgtccttcctccggcaatttcatcttcttgagcacagggactgcatcgcagttacctctcagcccttctccagggcgtcctaacatgacacactcccagggacagtgccccggcacgcacagagattgtcacacgtgtttgtccacagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccaggtatttgcccgagggagggcaccgactcttcccgctccctctgcccaggtcccagtccccagacaggtccaatcaggacctcagttcctgccgccctggaacatctgcatagttacggtgatcactgtaaatgtttccctaacgtccttcccttccccaacaaaacaaaagaaaatacaaagaaaaaaagctctgccgaaacatgaatttgcagataccgcagtgattccaggcactggtggggcggtgctgccccctggtgaaaaccagccagattgtagcagaaagcccgaagcaccttctctggcctctcatgatccggttttgagtcctggagttaatccccagctgtaggacacgctagagctgccctcagaagctgggagaacagccaccttggggagggtggttatgggtgaaaataactgattttgaactagggcacaggactggcaaaccgattcccctccattatttcagtttatttattattgttttttaatcttttttttttttttttttagacagtctcactctgtcgcccaggctggagtgcagcggtgtgatcttggctcactgcaacctccgcctcctaggttcaagtgattctcccgcctcagcctttccagtagctgggattacacagcgcctgccaccacacccagctaatttctgtatttttagtagagatggggtttcgccttgttggccaggctggtcttgaactcctgacctcaggtgatctgcctgcctaggcttcccaaagtgctgggattacaggtgtgagccaccgtgcccggcccccctcccttatttcagatggaaaagggccttttaggaagaggccgctgctccgctctgaactatgtctatggccttgatgggggctcttacaaggggttaaacaggaagccattcacagaggggcttagctgtacacccaccagggagaaggggccaggaccctgacaggaaggttatggagggaacaaacagagaccccttctcacctgggagttccacaagtttcttagcaaatggaccatcttgtttcccccagtgtgttctgaactctcgctctctcaatctgactcaatgaaaatgatttgtgtgtgttttcagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaagtgctccatctggccctagggaacacaccagatcttggaattcagttaccacctcctcccatagcccccatctcttcttaactgtatacacctgaatcccaagcttcagcagctcctcctaaacaatgaagtccaggaaatggcatctgggtgaactggctgattgcatgcggcccccaagaggatgagtgtaggttgccgtgattctccgtgcaatgcactggaaatctggatttttgtgattttagtttattttattattttttttttttttaggtaaataaaattttgaggaaccacttaattaggccccactggatgttcgcgatggacaacatcatccgccgagcggtgcaggccgcggtcaccattctcatcccaggtgagcgccccctttgtggtcaaggtcagctttaggccgtgaaaagataagaaatatcctcttcattcaacagttgttgcttttctcttttccatcttggttatctacttccttggaattaaatgcatgttgtcatagacttcttccggggctgattctgtagttctgagagcatctcgtggtgctgtatttacgtgtccctgaagcatgatgaaggtgactacacataaactataactcacaatctcaaaagggagcatggggccggacgcggtggctcatgcctgtaatcccagcactttgggaggacgaggtgggcagatcagctgaggtcaggagttcaagaccaggctggccaacatagtgaaaccccgtctctactaaaaatacaaaaaattagccaggcttggtggcacgtgcctgtaatcccagctactcgggaggctgaggcaggaaaatcgcttgaacccgggtggtggaggttgcagtgagccgagatcacgccactgcactccagcctgggcaacagagtgagattccgtctcaataaaaataaacaaatacataaataatattaaattaaaagggagcatggggccagaggggaaggatcctccagtcctctggtatccccttcatcgtgcactcaggaatgtttcttgggtaactgacaatacagtggctcagattcctctctctgaatcatcatgtagtagttacagaagtttttggtttttgtcaatttcctttttgaaatgttaccaaagttgattctccttctctggtgacttcttcctgctaagggaggctttacagcccattctgtcgccatcatggtttccccctttccttcagctccttgctgtttggctccagcccaccctcccgaatgcactgtgtagcccaggctcagctgcaggagaggcttgggaaaccccagtgcttaattcctctcccactccaagcagacaccttctgtagtaaaacggcacaggcttgggtggcagcctggctctacttatttctttcttttctttttttttttttctgagacagagtcttgctctgtcacccaggctggagtgcaatgatgcgatctcgcctcactgcaacctccatctcccaggttcaagcaattctcctgcctcagcctccggagtagctggggctacaggtgcgcgccaccacacccagctaattttttttagtagagacggggtttcaccatgttggccaggatggtcttgatctcttgaccttgtgatctgcccgcctcagcctcccaaagtgatgggattacaggcgtgagccactgcgcctggacctggctaatttttgtatatattttttagtagagatggggtttcaccatgttggccgggctggtttcaaactcctgacctcaagtgatctgcctgcctcagcctcccaaagtgcttggattacaggtgtaagccattgctcctggcctggttgtaccttttgaacgctggccttggttcacttcatatccttaagcctcaatttcttcctgtggaaactggcgtgatcaactttacgctgcagagaaccaaatggaacagtctcttctccatttgtaaagtcagcagtcccctaatggagcatggcacgggctgggccagcttctgaacagcccggtttgctgacctgggtgtctgcgaccccaggccccactggcctggtttgctcaccattgtcatgtcttgtgtgatttgcagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacaggtgaggagcttctgggccctcctctgggagcaggcgctgggacagtggcctgagccaccaagatgctgattaattggctttattgttgaccatctcacccaggtcttaggaaaaagcagcttcatcatccacgaactaggcaagggcgcatattctcagcctcaattgagggactagaggaatgccttcctttaaaaaaaaaaaaaaaaaaactcagaatcagagaggtatatatagtaccttgccccagaccacacagaaattactcatactaaaggcagcagcatctgtgaattctttctctcttttcaccaagacggggcccctggcatggtgtgtgggtctcgcaggctcagcagcctgcccctgcagaagtagcagggtttgggggttggttagcacttcatcagtggatgtacatcccataatcccgaccccgaggaagtttgtcctgttgtcatttcttccatgtgatttgtcatgatccctagacgggcattagtggactagcttcccaaccagggaaccctggcatcaccatcatattcctccaatgcactggtctgttttgttcacttcctggcacatagtaggtgcttaatatttgtgaagtggatgggcgtggtggctcacgcctgtaatcccaacactttgagaggccgaggtgagtggatcacttaaggtcaagagtttgagacagcctggccaacatggtgaaaccccatctcttctaaaactacaaaattagccaggtatggtggcgcacgcctgtaatcttagctgcttgggaagctgaggcaggagaatcgattgaatccgggaggtgggggttgcagtgagctgagatcgtgccattgcactctagcctgggcaatgagagaaactccatctgaaaaaaagaaaaaaaggggaagaaatatttgtgaaatgaataaaattattcctgtttgctctgggaagtcacattatcagctgcgtgatttggtttttaaaagtaatccatagttgaccgggcacagtggctcacacctgtaatcccagcactttgggaggccaagatgggtggatcataaggttaggggttcgagaccagcctggccaatatggtgaaaccccgtctctactaaaaatacaaaaattagctgggcgtggtggaacttgcctgtaatcccagctactcaggaggctgaggcagaagaattgcttgaacccgggaggcggaggttgcagtgagccgagatcgtgccactgcactccagcctgggcgacagcatgagactctgtctcaaaaaaaaaaaaaaaaaaaaaaaaaaaaaaaaaaaaaaaaaaatccatagttatagcaaatgagttggtactcattccaaatgacactttgttgctgtgggatcattgctgaggaatgctaatgactatttaaccgggagacaaggggccagttacgtattttggatgaaaggttgtgtatgctgtcagggatctctcaagttcaatcttagatcatctaatcatttctttttttaaaagacccagagctttagttaaatggtagtggtggcaacattttgaaagtttttttttttttttaagttcaagagtacaagtgcaggttttttacacaggtaaacttgtgtcatgggggtttattgtacagattgtttcatcacccaggcattaagcctagtatccattagttgcttttcctgatcctcctcccagcctccaccctctggtaggccccagtgtgtgttgttcccctctatgtgtccatatgttctcatcatttagctcccacggcacgtggtatttggttttttgttcctgcatttgtttgctaaggataatggcctccggctccattcatgtccctgcaaaggacatgatctcgttctttttttatggctgcataatattccatggtgtatatgtaccacattttctttagtctatcatcaatggacatttaggatgattccatgtctttgctattgtgaatagtgctgcaatgaacatatatgtgcatgtatctttataatagaaccatttatattcctctgggcatatacccagtaatgaggttgctgggtcacccaataagatttataatcaccaaattcataaaatgattatatatgggtttgaaggttatttctctccactgtcgatagtcattgtgttattttccagtctcagtggaatgaggaattggttaggcagcagccagtctgtgaatggcattgacgtaaactgtacattcctgcataaggtgcttgtccttgtgtgtattagtccattttcacgctgctgatacataccagaaactgggcaatttataagagtaagaggtttaatggacttacagttccacgaggctggggaggcctcacaatcatggcagaaggtaaaaggcacgtcttacatggcagcagacaagaaagaatgaaagaaccaggcggaaggggttttcccttataaagccatcagatctcatgagacttattcagtaccatgagaacagtatgggggaaaccacccccatgattcaattatctcccactgggtccctcccacaacacaagggaattatgggagctacagttcaagatgagatttgggtggggacacagccaaaccatatcactgtagtatgaagtgccttggctatgtggcagttgggcagagccaaaggaagatgacacctcttagacaggatgatgtgtctgtcctgatgaagtcctgagagtccttcccactggatacaggcacaagcttgagttgtctccttcactaacgtaaaaggaggactactagagagaccaggatgaaggcaggcagttgggcagggctgggagaggacttctaatttgctgagtgccaatatttcctctgctgttgtgctggggcagaagtgttctcctctccccaccccactttgccaccaaataatccaggagttcctgtgttctcatctctctactgttgcagtgacttctcatggcaacttcaataattaccttcagtctttttttttttttttttttttttttgagatggaggctcgctctatcatccaggctggagtgcagtggcacattcttggctcactgcaaccttcacctcccgggttcaagcgattctcctgcctcagcctcccgagtacctgggaccacaggtgcacaccaccacacccagctaatttttgtatttttagtagagatggggtttcaccatattggccaggccggtctcaaactcctgacctcaggtgatccacctgccttggcctcccaaagttctgggatgacaggtgtgagccaccacccccagcagccttcagtaatttcaataaagcttagttctgtattcccaagttcaccagcatggatcatataaatgaattaaaggaacacacagttaagaaacaaatcccatgtactaggtatgtaagcaaacaataaaagtgtgggggccaaggcccttggcccctggaggtttgctgaaaatcacctgcatgaggctgattaatgagagaaaaggcatgcaaatgtatttaacatgtatttaacttcagcatgaagacccaaagatccaggggaaattgtccatttttatgcttaggcttaacaaagtatggagagctgtggagaaacagggataaaaagggcctgatcgaatgctgatagactgagtggggaaacccagcaaggcctgtctgtctagatccttcttggcctctctgagtagcattcctttctcctgggtgtggggcaggaccctctggaatcgggggtcttatgaactacagtcaaacaaagtaggtcgaagaactttttttttttttttttgagatggagtttgactctgttgcccaggctagagtgcagtggtgcaatctctgctcactgcaacctctgcctcctgggttcgaactattcttctgcctcagtctcccctcccgagtagctgggattacaggcgcacgccaccacaactggctgatttttgtatttttagtagagacggggtttcaccatattggccaggctggtcttgaactcctgacctcaggtgatcctcccgccttgacctcccaaagtgctgggattataggcttgagccactgcgcccagcccaaagaatttttttttttttttttttttgagacagagtttcgctcttgttgcccaggctggagtacaatggtgccatcttggctcaccgcaacctctgcctcccaggttaaagcgattctcctgcctcagcctcccaagtaactcggattacaggcatgtgccaccacgcctggctaattttgtatttttagtagagaggcttctccatgttaggctggtctcaaacttctgacctcaggtgatctgcctacctcagcctcccaaagtgctgggattacaggcttgagctgccgcacccggccaagaatttctttataaccaatttttacacagaaaggcggagggaaagttagagtcgtatttttaggttttgtggctggctttggggaggagttctggtttctgtgccccgctttggggaagagggattctatggtgcctccaggagaatggactgagagagggaggcaggagaaggtcagaggaaaactttttcttctgaggctgctgctgaggccatttgggggcactgttttctgagccccaacaaaagctagacgtggttccaatctgtcagccctttcccccaaggcatgctatgcctgagctggcatgtgggggaagtttgaggcacagttgtgccaagtcatatctgatcccagagagcccatgagcaagactgggtttcaggaggcggtcccttgggaagagcccagcctgtggactctgggcgttacttaactcctctgcctcagttacctcagcttcaaaacaggggtttagaacaaccagtgcttcctagaagtgccgcagggcttcagtgactgaattcatgcagtgtttggcacagtcctggattctgggtaggaagtgcttggtggatgttggcaggagccatcctccccaccggcagagcagcatgtctcactcactgtccctgctctgccccattacaagcaggggcttccagctgggtgcggtggctcacacctgtaatcccagcactttgggaggccgaggcaggtggatcacttgaggtcaggagttcgagaccagcctggccaatatggtgtaaccctgtctctactaaaaatacaaaaattacccatgcatggtggcgcatgcctgtagtcccagatactcgggaggctgaggcaggagaattgcctgaacccaggaggcggaggttgcagtgagccgagattgtgccactgcactccagcctgggccacagagtgagactctgtctccaaaaaaaaaaaaacaaaaacaaaataagaagcaggggcttctgtccccttcgtttagtccctgtgtgaggaggaaagaaacttaccattctattctagtttcagctgccttatctgacttagggagccaggtttaaataatcacatcgtccttctggctgagttctgattaacatcggcatcttttggttcacgatacgtttttgagacaaaactgcctgagtgcgttcaggctactgtaacaaaataaccagagaccaggcagcttataaacaacagaaatgtgtttctcacagttctggagactcgaagtccaagatcgaggtgccagcagattccgtggccagtgagggcctgcttccccattcacagatggccatcttctcgcggtgtgtcctcacatggtggaagggatgagggagcctctggggtctcctttcacaaggacactcctctcacctcacctctcaaagctccgtctcctaacaccatcaccttgtgggttaggatttcaacatatgaacttgggccgggtgaggggcacacattgagtccattgcaaaaatatatccaagctgtgagcactggcctttgttgtcaaggggaggaaaacacaaggaaggttcccctctgcagactgaagtctgagtcacagaacctgaagaaacacatgtgcttccctctctaggctgactcttagacttgtcccattttccattttttttccatctctaatgtatgcacaacagatgcttgagttaaattgaatggtgttgaatgctctctggataatggctttttttttttttttttaaaccagacttttggaacacctagttgaaaaagagagagagtaccagaatcttctgcggcaaactctagaacagaaaactcaagaattgtatcaccttcagttaaaattaaaatcgaattgtaagtcattttccaatgagacagactttaacatctagctaatattctagttagctttgaagaaacatttgaggttatcttctgttaatccaggactccagtagattctagactacttctcaatcataaaaagggactactgatagattcaacaacatggctgcattgtaaatgcagtatgctaagtgaaagagctagattcacagccagcaccgtagctcgtgcctgtaatcccagcactctgggaggctgaggctagcagatcaattgaacccaggagttcaggaccagcctggtcaacatggcaaaaccccatccgtacaaaaaatagaaaaaaaccagctgggcttggtggatgcatgcctgtagtcctagctacttaggaggctgacatgggaggatcacctgagcccaggaggttgaggctgcagtgagccgaggtcatgccactgcactctggcctgagtgacagtgaaaccctgtctcaaaaaaaaaaaaaaaaaaaaagattcaaaaggccacataccatgattccttttcctccagaaaaggcaaaactacagggacagaatcagaatggggaggtgacgggactgattgtaaagggcacatgaggacttttgggagtgacagtcatttctgtatctgtgctgccaccttcatagcacattggacacctaaaaagggtagtttactgcataagtaaataaatatgcctccatcaacctgacattcgttttgggccacttagaaacgagctccagagctacctcttggaatgtggactagataagctctgacctcaacactaaaacctatttccttgtaggatttccagtgcagttagggatgtgattcctaaggaaaggcatttgaaagatgtggggataagcatttaaagtggtagacctaacatgtcaaattccaaactaactgaaggtatcctagatgaggaggctttctagaaagtgaatctcagaattatgaattgtgtaatacgtattagcgtggttcagtgatacagggttaattcatctctttttcacatcacatttacattctggaatcatttattaatccaactggttacttttgaagagttttatggttagactaatatataacaaattgccaatcgttacaggtattacagagaacccagcaggcccctacgggcagagaacagataaagagcttatagactggttgcggctgcaaggagctgatgcaaagacaattgaaaaggtaaatttacaacaaagaaattcttatgctgttgttacacagctgctcagctcttaaggatctgatctttgtttcagattgttgaagagggttatacactttcggatattcttaatgagatcactaaggaagatctaagataccttcgactacggtaagagcctcaaaacagtttgtataagagaatacaactttttatgtgtgaatatgcttcaagagcagaaaacaaagggctgggcctccccccaaactctggagttctattaggttcaagctgggaaaaagccaaggtggggcagaaactgaaagccaggcagaagtcagaaataggaatgtgacagagaagagctggccaatctcctgccattaatgcctggctgggagtgggtggaggcacatggcaagcgtgcctgcacgctggacccacccccttctttaaactgcagcctgccttcttgttcccgagtcatttgaaatagccagctctctgcaggtacgtacctctaaggccatgtcctactactgctgggacacgagcgtcacctccatatgtgaggagaatgtttttattttcattaggtttttaaattagggactgcagttttaagctctgttggcttgaagcactgactctgaagacagctgtgtttgtttcccaggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttgta

SEQ ID NO: 3206 - DNA, 125845 bp, human
cttttctttttcttttcaggacatggtaactcaaaaaaacacagtaagtattaacattttcagaattttaattctgaaattaaatgtaaatgtcaatttgtaaaatgcttgcctgaaaatcgcccaggtagcaagatgacttctaatcacgcctgtgggttgtgtttctaaggaggacagctagaaatctccctatgcctcaaccggccggccccaggccccactcagccattgaggcagtgggccagaaggcaaggcaaggccaggcaagaaagtgtatgttcttcattacctgctgggactttgagctgtaaccttctgggtgactccttctgatctgggtcgatgttccatggaccaccagtaatcgttttgctggagtcaatacctcccatacttcccaagcagagtttccctaatgatggaggaacgtgaagttgtatgccagttaatatggggcaaaagtttcttgccacaaacggaaaagaagtgggatggaattctacttccttctgtcccatttatgtactgaagtctcctgatttggcttaaaagttcctgaaattacatagttttattgccacgttggtttgaatagtataatgaaatcaccaccctaaaaatgttttaaaaggatcttggccttggaaatgttgccaaggttatcctgtacccttgagtgcactccaagctgcccatccctccagacctatggcattgtggtttgagaaaccgtgacctagactcaggacaggcccttggtcccccaccttacagccttagtctccttcctgctagctcttctagaaggaacaggcctacagactctcttcctattccagttggagttcctaggagagggagaaaagggcccaggaggcaaagctttcccctgggcgccctctgcagaagtccccaacctgcagcttgggggcccaggcttccccaggaccctgacagagctccccacctgagacataagtttcagaaacagagcacgtggtatagtgcacgtgattactattggagcatgaattttacaagcaggcctgtaagataaggcatccggtggttttagattccttttggaaaagaaatgggatcaggtgtgactttttttggtcccatttacatgctgatgttgtccacttgtaagagtctttcctgttcttcctagagcttgactttttttttttttttttttttttttttttttgagacagagtctcgctctgtcagccaggctgaagtgcagtggtgtgatcttggctcactgcaacctctgcctccagggttcaagcgattctcctgtctcagcctcctgagtagctgggattataggcgcctaccaccacgcctggctaatttttgtacttttagtagagacatggtttcccaatgttggccaggctggtcttgaactcctgacctcaagtgatctgcctgccttggcctcctaaagtgctgagattacaggcgtgagccacctcacccagccttgatttttaaaattacctaatttgtggagaaatggggaagaagtcgaaggagattgggcctgaggcccaggaggtgcagttgtagccgcagccctgtctctaagtaacactgggcagtcagttgttccacccctgcctaggcctcaggatcctcagcaataaaatgagaaatgttgaactgtgctgttttgctcattgataccttctagccctcaacatctgtagttccatatttgttatacaagcaaaaagatgtaacctggatttaatgcaagaaatggctatgaaatgctgattccttaaaacagcaagagttacgttgaggcaaggagcaaggaagacaactcgttttctttctccattcctcactgttggatgcatcagtactcagaaatagtctctcgtcccggagacttggtgtcacgctgttacaattccactacatacctccctcctggtgcattctccctcttccaaaacatccaggaattccttaacattcttagtaattccaagtataccttggcactattcttcctaggtatctgtttgctttttaggaataaacttactctaaagcagcggtccccaaccttttcatcaccagggactggtttcatggaagacaatttttccacagaccagaggtgggggatggtttcaggatgaaactgcttgacctcagattatcaggcattagattctcgtaaggagcacgcagcctagatcgctcacatgtgcagttcacaatagggtttgcactcctgtaagaatctaatgtcaccaatgatctgacaggaggtggagttcagacaataatgcttgctcacccaccactcacctcctgctatgtggcctggttcctaacaggccactgaccggtactggtccatggccccgggggttggggacccctgctctaaaggatttggcagctaatctctttgctatatttggcattatgttagaatttggtgcccagtattggttgtcatgcttggcaagatgtgaaaatttagagcactcagaagactaaaaggatcccaggtgatgggatgagtggaaaattgcactaagaggaaaagctaaagggaactaagccttgaggggtaccattagtagtcatcttcaaatgctatcctctttctgaaagaaaagagacgtttactttttccactccagatgggatggaagtagggtaaacagaaaaatggtttggatcagcagaatggacatcttgcaactaatggtggttaaacattaaaatagaatgtcaaagtaacttgggtggcttctaaggagaatttgctcaattgtcccctccatgtggattggggtgaccctggaatcagacacctggatcatacgaccccagagattccaagacagaatctgatggaattgtgggtttatgatcattttggaaagattttgattaacacacacacacacacacacactcatagttagtgaacagtgaagtcttataaataaggggtacgaattagatgccacaccctgaacatgtagccaggtgtttgaaatgatttctgaatatgtgaaaaccaagatgcattgagatctcttttcaaggagtcatttgatatttctaaaattgtacttttacccagaaagggagatggaaaaataaaaagtaataaaataataataacaaagataaaattgtgcttgatgatgtattgaattcagctttatgtggcagcgaagtgggcacatttatctccatttcttttttttttttttttttgagatggagtcttgccctgtagcccaggctggagtgcagtggcatgatcttggctcactgcaacctctgcctcccaggtttgagtgattcttctgcctcagcctcccgagtacctgggaatacaggcatgtgccaccatgaccggctaatttttgtattttttttttttttagtagagacagggtttcaccatgttggccaggctggtctcaaactcctggcctcagatgatccgcccgcgttggcctcccaaagagctgggattacagatcacgttgcctggccatttgtctccatttctaggagcagttgctttgcagggatgccgaggccaggaagccaaactccagacttcagggtggaccacctgcagctcttctgggtttctttgctctttggaaacatggtatcaccttttgtgttcacctctttttcagatgatgctcatattcttgtgttctggttttgttttgtttttttgaaatgctttatgtaggtataatttacataccacaaaatgtacctagtttaagcacacacaattcaatgatttttaataaatgacataattgtgcagccagttgtgggttgtgtaccacagtctagttttagagcatttccctgaccccaaaatgcttatttgcagacaatctctcttcccacacccagccccaggcaagaactaatctgctttttgtcttatagacttgccttttcaagacttctcatgtgaaaggaaccatacaatatgtgatcttttgcatctggcttctatcacttaggatgatgttttcgaagatcatccttaatgcactaggatcatggatgcatggatcagtagttctttcctttttattactgaatggtattctactgtatagatattccacattttatccattccctagtagatggatttttggatcgtttctactttctggctattatgaataataccactgtgaatattcgagtgcaaatctttgtgtgggcacattttttttttcctcttggatacatacctaggaatggaattgccaagtcatatggtaaatataggctttttttttttttttttgagctggaatctcactctgtcgcccaggctggagtgcaatggcgcgatttcggctcacggcaacttctgtctcccgggttcaagtgattctcctgcctcagcctcctgagtagctgggattataggcgcccaccaccacgcctggctaattttttttgtatttttagtagagatgcgatttcatcatattggacaggctgatctcgaactcctgacctcaagtgatccacctgcctcagcctcccaaagtgctgggattacaggtgtgagccaccgtgcctggctggtaaatatacctttaatttcttaagaaactgtcaaaacaattccaaagtggctgtaccattttacatttccaccagcagtgagaggtccagtatcttcacatccttgccaatacttgatatcatctgtctttttattatagccattctagtgagtatgaactgatacctgagtgtacttttagtttgcatttccctagtggctaataatgttgagcatcttttcatgtgctgattggtcattcatagtcttctttggtgaaatgtctgttcaaatcttttgcccgtttaaaattgggctgtgttcttattacgaagctgtgtaagagttctctatacattttggaagcaaggcccttattagaggttttatcaattatttcttttatggatcgtgcttttggtatatctgtgaactcttagcccaaaccaaggtcatgaagtatgactcctatgttttcttttagaagttttatagttttagctcttacatttaggtctctgatccattttgagttaatttttttgtctggtgtgaggtagatgtccaacttcattctttctcatttggatccctagttgtcccagcactgtttcttaaaaaaaagaaaaaaaaaaactgtcttgtcatctttgaatcatctttccaccctcgtcaaaatcaattgactgtatacgtaagggtttatttttggactctcaattatactccattgacatatgtgtctactcttatgctaataccacactggtttaaaacttttttttttttttttttttgagacaagttctcgctctgtcacccaggctggagtgcagtggtgcgatcatggctcactacagccttgacttcccctggttcaggtactccttccacctcaacctcccgagtgcctggaattataggtgtgcaccaccacgcccagctaatttttttattttttgtagagatggggttttgccatgttgcccaggctggtctcaaactcctgggctcgagcagtctgcccacctcagcctcccaaagtgctgggattacaggcatgagccaccatacccagcccttttttttttttttgagacagagtttcactccagcccaggctggagtgcacaggctccgctcactgcaacctctgcctcccgggttcaagcaattctcctgcctcagcctcctgagtagctgggatcacaggtgcccgctaccacgcacggctaatttttttttttttttttttttttaagtagagaccgggttttgcagtgttggccaggctgatctcgaactcctgacctcaggtgatccacctgccttggcctccaaaagtgctggaattacaggcacaagccaccgtgcctggcccgcacccggccctttttaaaaaatttatttttctttgttttttgttttgttttgagacagggtcttactctgtcaccgcagctgtggtgcagtagtgcaatcacagctcactgcagtctgcactattttgattactatagctttgtagtaatttttgaaatttggaagtgcgaatcctctaactttgttctttttcaacattgttttggccatttggggcctctcaaagttccatatgaatttgaggatcagcttttccatttctggagaaaaaaaaagccattgaatattgataaggattgcatcgtatctgtagattgcttggctggtattgacatcttaatagttttaagtctactaatctgtgaatgtgggatgtctttccatttatttaggtcttctttaatttatttcagcaatattttgtagttttccatgtacaggtctttcactttcttggttacacttactcctgtgtattttattcttttggatactcttgcgaatggaattgttttcttaatttctttttcaaggttgactttaaaaaaacacctgtcacaaaaatcttcaacactacatttcacttcatatttcagtatttgattgagttgaaaatgtaattgactttttggtcagagttctatacaaatggcttctggtttttcctgtattttcatccattttaattcttacactattttatactgctttggagatgacagagatagccactttctgcagtttatcactttagagaaaacatgtttatatggtgacagatcaaggctgtctttatgaaagtaaaagagtgaaaatacagccaaccccaaggctactttatctgtttaaccttggaacttcctagtactttgccactagtgtacatagtccataggcattgcgtagcttcatttgttttaattttccttagcaaggataatcatacctttatacttacagcttattttgcaggttgatttcctctagactcagactctgaggctgagtttagggtacaggaggtttattaagggatgcctttgggatggctgctggggaaggggagtaaatgaagcgggactggccagagggagacatgcagctgagatgcaggctcaatgacagctttggctgaccacattgggagggaggtctggagctgaaatggcctttctgagttgtcttgggttgggatgaaatggccaggcctctatgttcctccatttgtccttcatcactaggaatgtagcttggatgagatactctctggaactgacacagttcagaagggactaacagtaaggggctgcttcctaacgagctcccagaaactggggcaacacatccttccttgaggttgggttggggggttctgggtagtatacctgcatatccaccacattataattatttcatttgagaaatgtgtgtatgtatgtgtgtcatatataccccaagactaagaaatacatttccaaggcttagaggtactgctataatttttttccactgaattggtgggtaaattacctgaaagctgtgcatagccttgctagagaggcaccatggagacaagcaccttctctgtcccccaggagaattactgggagaaaacaaggtgttctacccaacacttgcagaaggaattgttaaaagtacattggactttattttcatttgtcatgtcctaaagccagagttcacagttgtttttttaaaaagcagagttaaatttccaagctaagatcacattattaaaaaaaaaaaaaaccttattaaaaaacacgttattaaaaaactaatctggttcttgacctctggtttaggtgattttttttttctggaaagccagtgagatttaagagaaactcattgttgccattaaaatggttatctttataatccaaataaattagaaattctttgaaaaacagacactggcaatattggagacagtgtcttcaatactcgaagtctctcctctggcttaggaacatgtgtaggtctcggtcagggtaacaatttctcctgtttttttcctcttgccattctcaggccttcagtttcctatggcttaggactcaaaatgatcaaagatgatatggattgcttagggacgctttggtagaaagacaattaagtttcttttctcttttctgtatcctttggattttctgagttcaaaagatttctagtacttttattagcaaagactcaatttcaaacaagaaagctacatctcataatagggagaattttattttactcacagaacatgaattatgtaaaaatctcagttggttctttctctctccctccctctttctctctccccctccttccctctctctctctctcccccttaccctcccccccttcccccctctctccccctctctccccctctccccctctcccccctctccccctctctcccccctctctcccccctctccccctctctcccccctctccccctctctcccccctctcccccctctccccctctctcccccctctcccccccctctcccccctctctcccccctctcccctctctctccctgtccttccctctctctctctccctgtccttccctctctctctctgtctccctgtccttccctctctctctctctctctctctccctgtccttccctctctctctctccctctctccccatccctccctccctctccctctctccccccgtccctccctccctctttcttctccctctccttcttttcttccttcattcctttttcttttcttttctcttttcttttccccttcttttcttctttttttttttttttctaacactcttgctctgttgcccaggcaggagtgcagtggcatgatcttggctcattgcaacctccacctcccaggttcaagcgattctcctgcctcagcctcctgagtagctgggattataggtgcccaccaccatgcccggctaatttttgtgtttttagtagagatggggtttaaccctgttggccaggctggtcttgaactcctgagctcagatgatctgcctgccttggccttggcctcccaaagtgccggggttacaggcatgagccaccatgcccagcccctttgcatatttattttatttttgtatgttctgttatttctgcctcatcttaggttgttagtctttttgtctttttgttgttgttgttgttgttgttcctgcctgtggtcttggtcctgtgtgttctcttcaattggagtactctgggtctgtgaaccataaaacttttctctgcacctcttgaatatcagaggggtaatgtcagatttcacagggccaatgtcagaaccaaattattcatatttaattctacctgccaactggatatgtctttcatatccatggcacccatctattttctttaaatcgagacataattcacagaccatagaatttgccattcactcatctgcttatgttgagttctttgtacagctttatttaaggatatttcagaattaagcagaagtggcagttaatgactagaatcctgggaggacaggggtagggcctgagattatctggctccgtggtcatctgtaggccagttggttaacctgctgggtcttggtttcttcctctgttaaatgagatgattttaatgaggtgacttttgagatttgtgccagctctgaaataatcctgtgactttgtgatggccattcagttgtgtaaacaaagtaaatcaactgtcacaacaggttaattagcactccatggcacgtttccagcagggatatcttcgtttacttttaagtggcaccgtatcctgattatcctgttgaaattgttatacagtttctgaatatttttttcctcctatgaccagataattagagaaaaggagtagtgtagaatgctatttgcgttgctctaaaaagaaaaccactgcatttttctggacaatgtatatatgtatgtatctagctggctagacaaataattatatctgttgagcctaaagcttatcttttttggagttgtgtcaacttggattttcttctacaataaattaactttgtcatacctggtcacatgaaataatataaaaaatccattgccccgtatttgttcatttgctccctaaattttcctgggaacaatcttctgtgttttttcagttgcggttttcactaagtatttgtgacccacttgtgttaaaagatataagctccaaagtatcacattgtgccaccagttgagatgtgcattcttctgaaagtgctcagaaatcagttcatcttgagtagtgttaagtggctttctatctgccttagatactttatttccctcttctcacttggccatttgttgactgattaaatgtttgtatcattataaaagatgttttctggaaggccaagccacaagtctcattatgaagttcgctggtacaaactcagacatatcatatttgctgcaaagaattaatttataaaccctgtgctgctgttgaccagctttgccacctgctgtgagccataaataaaaataagtgctggtgtaatgagggaccttggcttgtatatctttcttggccttcttggacctttggatgccttgcatggggtgcctgcggaaaagaaggaaaatatagccaaccccaaggctactttatctattaaaccttggaattttttagtagtttgccattagcgtacatagtccacaggtattgcgtagcttcatttgttttaatattccagctgtggaggagccagctgaggagcaaatcctaggtgtccttagttagtggccatgattgaagccaatggacaattgagtggaggctctgacatgctctgctcctgggctgtcctgaagaatctaggaagctgtttgcagatgggccttgcactgtttattcgtggagagctttatatgtgcagcccactgaaggaagtccgacattttaggcctgcagttaggatgttctacgtgaagcatctaagagtcacgattgggggtttttagccttttaggggtcacgggacccctttgccagtctggaggagcctatgggcccttcccagaatatgttttaaagcaagggtcctcaacccctgggccacccgaccgggccgcacagcaggaggtgagcagcgagcgaggaaagcttcatctgtatttatagctgctcccccattgctcgcattaccgcccgaacgctgcctcctgtcagatcagcagcggcattagattctcataggagcataaaccctattgtgaactatgcatgtgagggatctagtttgtgtgctccttatgagaaactcatgcctgatgatctctcactgtgtcccatcattcccagatgggaccgtctagttgtaggaaaacaatctcaggggtcctgttgattctacatcacagtgagttgtataattatttcattatatattataatgtaataataatagaaataaagtgcacaataaatgtaatgcacttgaatcatcctgaaaccatcctccctgcccctgcccacctggtccgtggaaaaatttttttccatgaaaccagtccctggtgccaaaaaggttggggaccactgttttaaagtgtttaaatacaaagaattacaaaggagacccttcatatcaaaatacagttatcaaaatattttaaagttatatataattatgtgcttctttactaatgtcttaaataatgagatcaaacagcagatcttaaaaactgtcataatatttggagtagtgatgggcataaaagttattctgagatctccgcaggaactgtaatgtgatatgaaaaagtctgtgactcctgttaccaacaaagtctcaagtctcaagtctactactagggtatgttacctacattccctaagtgagggaaatgttatgtttcagttgagggcaaatgatggcaatgatgtaatttttttctctttcaagttcacagacccccccccccaacctccaagaatgactggatctcaggtttagaactcctagtcccttctagaactattgcacatagagaatatttgtgcaaaaaaaaatggccatgattaagcctctatcatctaatgaggctgacactattatcatctccctcttaaagatgagaaaactgaggtttagatagatgagtacatttttcagggtcatccatttaggatgggatggagctggaattcaatccttggccctctgaattctttactacattgctatgcttgagttgagatgatactttgtttctatattgataaagtatttcttgttcaccacacttcacaaatgtgaaaaacaatactatccagttcagctgagaggacgaataaattagcatgcccttatacactgtgggtgggagtgtaaattgctccatcctttatgacagcagtttggtcaacatatattaagaaccttaaatttgttctagtaattttactcctgggaagatatccttaggaaaagatcacagtacaaagatgccatatgcaaagatgttcatctcagtgacacttacagtaaggaaatttcaaaacaaacaaagttaggcaatagaagaatggttaagtatcctatatatatttaccagatggtgtattaggcaggcatttaaaattatggcacttaagactatataattaagcttttgtaatgagtccttattaaaagcacctattatttaattgagtgatgacataggacagtcttttcatggtggtgatatttgtagatggtagtagttctggaaatggcaattgctaggtcaggaactaaaacctttagaggaaaaattcctccgcttcctatccccacgctgtcagagactagtggcttttccttgggcctctgacttcacttactatatcagaatcaccgttttggaaatatttggagagtgtttagaataggactttacattttaatgtggttagcatactggttcaaatacctctttatgtaggaaactaaactgcgtttgttaaatttgttttaatgagctggattcttgagatgtttccacttataaatgtaacaactacaaatagctgatcctagtttgctattgaacatgtgttatggtaatcattgtttttatttttaatttctggtctcttgaccaacaagagtctgaatgtgttccatcacttgaagatgtttaggtttattcttcctctttgtaagaacaaaagtactgtacttaagagcttgtgctttcacttggaagtctattaattcctttttaaaatgtagttgttagtcccaatttctgccaaatttcttaaactttctggaagactttcccaaaggaagtatttttaccttcccaaagtctccggattcctgctgtctcctcagtcctgttcattaaactcactcaactggtttcagagttcatgcatttcttttctttctccttatttttctctaactatggctaaacgtttgctccgtggatcagatcctctgctgactggggggtagacttcatcagtttctgctgctagtgctctgccttcttgaacagtatttctttttcaccaaagaacttgtgatggcatttaccatgtttgtcaaaatccagtttttcacacctcattatttaggatttgatcagaactctggggcaaagttgactcttgtaatatttgggaggactaggtttgctaaaggaataacgtcaaaatttcagcagaaatgtttgttttggagacagttgtaagacatataacaattctttacaaataggttagattcttgtatcttcaatttacctacctgttacagaagctcagggttatttaattgtaataagtatttttgtattatgtcttttaaagaaacagaataaaagagaatgtaggtagggggagagagagagttatattaacctttttatttaccatttctgatacttttcatttgttcctgtggattcaagttaccatttggtgtcatttccttattccaatatagccttgttcctaccaatatccttttgctgttattttcaaatgtattacatttctgtataagccgcaacacatgattataaacatcattttctgcaactgctttttaaaccagttaagagaagaaaagaggaaatttgcaattatactatcttttataattgcatgcataactacctttactggtattctttgttttttatcacgtgaattcaaattactatctggtgtcatttgctttcagcctgaagaaatttctttattattattattattattattattattattattattattatttttgagacagagtctcgctctatggcccaggctggagtgctgtggcgcgatctcagctcactgcaagctccacctcccaggttcatgccattcttctccctcagcctccggagtagctgggactacaggagcctgccactacgcccggctaatgttttgtatttttttagtagagatggggtttcactgtgttagccaggatggtctcaatctcctggcctcgtgatccacccaccttggcctcccaaagtgctgggattacaggcgtgagccaccgcgcccggcccctttagtatttttgtaagatgggtctgctagcattatctcagcttttgttgatctgaaagtgttcatatttcatcttcatttttgaaagatagttttagtggatataaaattcttggctgactttttttttctttcagcactttgaatatgtcatcccgtggccttcgttgtttctaatgaaaagtcagacattaatcttactggaattctcttgtatatgacaaaacatttttctcttgctgctttcaggattttcactctttatctttcaaagttaactgacacatctgggtgtggacctctttgcctttatcccacttggagttcatttggcttcttggatatgtagatttaattttttaaaaaatgatatctggggccgggcacggtggctcatgcctgtaatcccagcactttgggagaccgaggtgggtggatcacctgaggttgggagttcaagaccagcctgaccaacatggagaaaccctgtctctactaaaaatacaaaattagctggtgtggtggtgcatgccttaatcccagctacacaggaggctgaggcaggagaattactttaacctggtagacggaggttgtggtgatccaagatcgtgccattgcactccaacctgggcaacaagagtgaaactccatctcaaaaaaaaaaaatcatatttaggaagttttcagcaattatttctttgagtatttttctgctcctttctctcctcttcttctgggactcatattaggtgtcacatatgttggtgcacttaatgctgtcccatgttcctttaagactttgttcattttttctttttctgtcttgttcttcagattgcatatctctatttttctatcttcaagtttgctgattatttcttctgccactcaaattgcctgttgagcctcctgagtgaatttttcattttggctgttgtacttttcaacttcagaattcctaccccccctccttttttttggtaatttttctttatcttctgtgtttgagatactgttataataccttcctttaattctttaagtatggtttcccttagttctttgaacgtatttgtaatatctgctttcaagtcattgtctgctacatttaatatctgggtcctttcaaaggcagttagcattgcctactgtttttcccatatgtggatcacactgtcctgtatttgcatgttttgtattttttgttgacaactggacatttcagataatatattgtagaaactccagatactgatctttctcccttctgcctccggggcatgttgtttttgttgtttacttgtttatttgtttcatgacttgactagttcagtgaagtctatttttctgcaatgggcagcctctgatgtcacttctttttttttttttaatttaagttttagggtacatgtgcacaacgtgcaggtttgttacatatgtatacatttgccatgttggtgtgctgcacctattaactcgtcatttagcattaggtatagcacctaatgctatccctccctgctccccccaccccacaacattctccggtgtgtgatgttccccttcctgtgtccatgtgttctcattgttcatttcccacctaagagtgagaacatgtggtgtttgattttttgtccttgtgatagtttgctgagaatgatggtttccagcttcatccatgtccctacaaaggacatgaactcatccttttttatggctgcatagtattccatggtgtatatgtgccacattttcttagtccagtctatcgttgttggacatttggcttggttccaagtctttgctattgtgaatagtgccgcaataaacatacatgtgcatgtgtctttatagcagcatggtttataatcctttaggtatatacccagtaatgggatggctgggtcaaatggtatttctagttctagatccctgaggaatcgccacactgacttccacaatggttgaactagtttacagtcccaccaccagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgtcttttggctgcataaatgtcttcttttgagaagtgtctgttcatatccttcgcccacttgttgatggggttgtttgtttttttcttgtaaatttgtttgagttcattgtagattctggatattagccatttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaaaggtattgcctaggttttcttctagggtttttatggttttaggtctaacatgtaagtctctaatccatcttgaattaatttgtgtataaggtgtaaggaagggatccagtttcagctttctccatatggctagccagttttcccagcaccatttattaaatagggactcctttccccattgcttgtttttgtcaggtttgtcaaagatcagatagttgtagctatgcggcattatttctgagggctctgttctgttccattggtctatatctctgttttggtaccagtaccatgctgttttggttaccgtagccttgtagtatagtttgaagtcaggtagcgtgatgcctccagctttgttcttttggcttagggcattcaattaggaaaaaaggaagtcaaattatccctgtttgcagatgacatgattgtatatctacaaaaccccatcatctcagcccaaaatctccttaagctgataagcaacttcagcaaagtctcaggatacaaaatcattgtgcaaaaatcacaagcattcttatacgccaataacagacagagagccaaatcatgagtgaactcccattcacaattgcttcaaagagaataaaatacctaggaatccaacttacaagggatgtgaaaggcctcttcaaggagatctacaaaccactgctcagtgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatgatgtcacttcttaaagggcacactcttgggcatgcgcacagttattctgactcttgtatcctcacccaggaatgacagtagttgcagctaggctctctttgactgtctgtttccctgatctccctgttaagtttctgactaatcttctgtattggtcttacacaactggtactacactgagttgttagtctccctccttagctgattgttctattgcttttgacaataccttgaggcataattgttccacagtttgatacaattaaagttttgcaggaatagtccttaaaactaatccctaaggcttggtctgacctcaggaaggttcctcctagctgtctctttcccatttctctctgttaaacttctagctggtctaccctttacatattcctatcacagagctaccagccttctcttaattgccagccaccaaaatctccataatgttttgtacagcactcatgagcttaaacttccccatggcacattctgcatgaagtcactctccttgtgaagagctgcagttcttacagcctgcctttctcctggtcagagctctgtaccactgctgtggagatggcagtggaaacagcagtctgtttctcttggggtgacactctgctctgtgagtggggtgctggctgggggcaacagcctctagtcttctcagcttgcctctcttggcatagaaccttcattctgtgagggagctggggcagggacaatcaagtttcagcattcttggcctgttttttgtttgtttctttgtttttgttttgttttgagacggagtcttgctctgttgcccatgttggagtgcagtggtacgatctcggttcactgcaacctctgccttccgggtttaagcaattctcctgcctcaacctcccacgtaggtttcactgcaacctctgcctcccgggtttaagcaattctcctgcctcagcctcccaagtagctgggattacaggcgcctgccaccacacctggctaatttttgtatttttagtagagagggggtttcaccatgttggccaggctggtctctaactcctgtccttgtgatccatccacctcggcctcccaaagtgctgggattacaggtgtgagccactgcgcccagtctcttagcctgttttgcctagggtagagcttctaccctacaggtgtaggctgggtagagcaagggagccctggtcatcttgaccacacttgcctggaatagagcttctacaatatcaggctgcgaggaataagaatgttggtggcctggtcttctaaggagaaacagtgactctggaccagggacaagagggagcccttttgtcttggccacacctacttagagtagaacttcagtcagtctgggctgggtgtgggggcgggggagcagtttatggcccaaatgctgcagaatcttactaacaagatttagattttcttgaataaaatgtttttccatttgctacatgccctcaggacaacttatagagactttaaatcaggggtgttcagtcttttggctttgctgggccacattggaggaagaagaattgtttgggccacatgtaaaatacactaacaatagctgatgagctattaaaaaaaaagtttgtgtgtaaatctcataatgttttaagaaagtttacaaatttgtgttgggccacattcaaagccatcctgggccatatgtggtccatgggccccggttggacaagcttgctttaaatggctgtttaaaaagaattttcatcagttatggttgtctttctggggataggatctgggaagctccttacacttccagtccaactttaactttttgaaaataacaaatgatgtttcttcaaaggtatttttccttctagacctcactgatctacacagtccttttctccctctgtctgaactaggaagtctttgaccataacatcaaccaatttcaggtgtgtattagtccattttcatactgctataaagaactgtccaagactgggtaatttgtaaaggaaacaggtttaattcactcacagttcagcatggctggggaggcctcaggaaacttacaatcatggtggaagggggagccgcaggcaagataccttcttcacaaggcggcaggaaggagaagtgcctagcgaagggggaagagccccttataaaaccatcgggtctcatgagaactcactcactatcaggagaacagcatgggagaaaccgcccctgatgatcaagttacctccacctggtctctaccttgacacatggggattacggggattacaattcaagatgagatttgggtagggacacaaagcctaaccatatcaaggtggaagaaagaaagtttaacttttgaatatgtaaatggcatttaatttagtctaggaacatggctttcttggcatggatgagggagaaatttacctctaacttaccaaaaccttaatgctgaatgatttgagtctctttaagaacttgaaagtattacaaggccaggtgcagtggctcacacctgtaatcccaaccctttgggaggccaaggcaggaggatcgcttgagcccaggagtttgagactgcagtaagctgtgattgtgccaccgcactgcagcctgggtgacagagcaagaccttgtctcaaaaaaagaaaaaagtgccacagggaacagagagtctttgttcctgtggggtaggcaattcctagtggctgtgaagaagtagataggagcctgctaccccacttatcacacacacacacacacacacacacacacacacacccctacacacctgaatttttaccctttctacttacaacactggtatttgtgggttttggttttgttttgttttgtttttgatgtagtctcgctctgttgcccaggctggagggcagtggtgcgatctaggctcaatgcaacctccgcctcctgggttcaagtgattctcctgcctcagcctcctgagtagctgggactacaggcatgtgctaccacacccggttaattttttttttttttttttttaagtagagatggggtttcaccatgttggccaggctggtctcaaactcctgacctcaaataatccactcgcctctgccttccaaagtgctgggattacaggcgtgagccaccgcgcctggccagtatttgtgttttgacagacttaataccaatagctggtacccacaaggatggtctccagctgctgctttgcagcaggatgtaagtattctcagaaaaccaaccctattttcagggataatagaatatcagaagctttgtctaagacaacattgactcgtcacctgtttctgtatgtcctgggagctaagaatggttcttacacttattaatggttggaaaataacaaagtaagatgatgatttcaggacacgtaaaaatacgaaatttaggccagatatggtggctcaagcctgtagtcccagcactttgggaggttgaggtgggcggattgtttgagccctgaagtttgagaccagcctgggcaacatggcaaaaccccaatctctacaaaataatagaaatattagctgagcatggtggcacgcacctttagtcccagctactagggaggctgaggtgggagggttgtttgagcctgggaggttgaggctgcagtgagccatgttcgcgccactgcacttcagtctaggtgacagagcaagaccctgtctcaaaaagcagaagagatctgagactcattatattaatatatgcttcctacaaaacaatttttattccacaaagtttataatagctcacctatagttaaatgatcaaataatatgcctttttcatctatgctgaaagaaaaaacaatatgccatgttgcaatccttgcttatcaggaggttcatgttccctctggttttgggcacatataatgaaacaatgtgatttctgagatttaaaaccctaaaatttctgccagtgaagttcagagatacatacagatcagttcagtatttgaaaccaaatttttgtcatatatctacgtggtagagcttttgaaatcgagcggtttcctgttttgtgcctaatagatccatagtcgtattgaacgaattgttttcatcctcaagtattttctccatgcctgtcccaccaggcgccacctgcccagagcctacacttccacataagttactttctggaacatctttgtttcttttttccaggcatccagtggaaattattatttcatcccatacatcgtgacaccgtgcgctgattatttttgctgcgagagtgatgcccagagacgagcctccgagtacatgcagcccaactgggacaacatcctgggcccgctgtgcatgcctttggtggacaggttcattagcctccttaaggacatccacgtgacctcatggtaattcccatctgccaccagtaacccctggagactcaccaagatgtccccatttctttcagggaagcggtacaccttcaaatgaacagagttgctggagaacccactattgtcccttactggctcacttagctgggccactgaaatgaaaccaaaagagaatagaactggagttaagaagtcgggattgagcccgtgtctggccctgactccctgtttgatcttgacatgtaacttctcttctctctgattgttctgtctcttctagataagacaacttataggaagttgtcagtgatttttttttttttaacgatctctttcagctctgagatcctgtgtttcaagatgatttctgagcatggctttacactcgcgtggctgttggggctcttcatatatctcagcaaggtcattctgaccttacgctctcgtgctttaaaagccttcgtgcgttgagtggagctgcagctatcctcaggatgtactgtgctgtgttctctttagatttaggttaggtgaggtgaaatatgcagaagtgaataggtttagattggaatcttggcttagatgattcctacctgtgtagcactgaaatagtcagctcacctattggagcctcagtgctcaagaaaccataccttcagatgttattattgtgaaagtaaaagaaaaattattcttcttaaccaaaggatccagttattttgcttgcagccaatttaaaggatttattcctgtaagttgtgtcacaaggagaaggatttgtccttccaaaacaaatgaaaatcccaaacactggcagagctgacctgaaatgaaatgtagaggacctcctgtcacactgtggctcaaatagtggcaccctgaactgcggagtgttctattgtagtgttggtacaagggagacacttattaatggtctccttttctatcccgtcacctcttccctggatacagaccttcttctacagactttaatggaaaaggagattagaaacctaaacatgtgtgaccacatgccaacacagagagcaaatgggggacattttgtggcacattcctggaaaacctcatgcagtcatgccttgctaactgttgtctgattgcaaaacaaacacttgagtgaagttttatagaaagctctcccaataccatattttcaagtctgacaaggaggtagactggctagatctgccagatgatttaggtctttgcaagacatggattcaagtttgtttctcactcagtgtgtgtatgtatcagtaggcaaacaactcttgtgatttcatttagtttcaaagggcttgaaatacctattggtggattccaccctctgaactggcagtgtctgacaacagttagtaggaggggaagtggtgcttatagtttaaaacatctataacacagatggaaaggaagttttgagctcaagcgccagctctgatagatttataaagtctattttgagtcctgtgctggaatggcttggaagccatttccaagtgctcattgatcagcaacatcttccttggttacaggggcagaaatggctgcatgcttattacatatctgatgtccccaagccatactcaaaccagtgtttaatttacctaaaaggtactgttcttcttaggtttcttagtttattaaaattatttttcagaattacccttgaaaaataaggctgaagtataactttttacttatcgggctaacctaataacactttaatagcttcagtgcctttatagtccaccaaatgtgcaatggctggcatccaacttaatgactcattcaattagtgacagaattttaaacactggcagaatctgctaattttgttcattattgggatgatggcaattaacaaaaaaggaaatagaaaactaaagcaatgcattgatatttttctatcagaacccctgctgtgtgcgtcacttcattctttaaatgttaatggaggtcctcttgtgagcattggaccaggttatgtactgtatgtacacatatttggcattgttttgtaattattgaaagtaggcaccatttgttcttatcgtatctcatgttgtttttctctctttgaagactattattaaatttagcttactctctttttaatgaacagcctaattttacactctgcagttagtccatttcagctttgttttgtgtgtgtgtgtgtgtgtgtgtgtgtgtgtgtgtgtgtgtgtgtgttttagaccaagtctcactctgtcgcccaggctggagtgcagtcgtgcgatctcagttcactgcaacctctgcctcccgggttcgagcgattctcctgcctcgacctccgaagtagctgggattacaggcacccaccaccaagcccagttagtttttgtatttttagtagagacggggtttcaccacgttggccaggctggtcttgaactcctaagctcgggtgatcctcttgccttggcctccaaaagtgctgagattataggcctgagccactatgcctggccccatttcagcttcttaatgggacgacagtattactgcttggcagtgtcctacctccacttaaaaattcctatggaaaatagacaagatattttaaatcaatctatggttgttgtaactcaacttatgtataccaagttaggtcatttttcaaggttttaaaccaaataccagataatagcattggctcttcaagagactatggtgatattccagcgtgaatttaactgctttaagtgtttttaagcttcctcgtgcttatctagctgctcacctgagggaagttttgtgttttccattagaaaactattcttgggtccaggcatggtggctcacgcctgtaatcccagcactttggaaggctgaggcaggtggatcacttgagtccaggagtttgagaccagcctggccaacatggtgaaaccccgttctggctgggtgcagtggctcacgcctgtaatcccagcactttgggaggccgaggcgggtggatcacgaggtcaggagatcgagaccatcctggctaacatggtgaaacctcatctctactaaaaatacaaaaatttaactgggcatggtggcgggcgcctatggtcccagctactcaggaggctgaggcaagagaatggcatgaacccaggaggcggagcttgcagtgagccgagattgtgccactgcactccagcctgggcgaaagtgcgagactctgtcttaagaaaaagaaaaaaaaaaaaggaaagaaaccctgtctctaatagcaatacaaaaattagccaggtgtagtggcacatgcctatagtcccagctacttgggaggctgaggcaggagaatcgcttgaaccagggaggcggaggttgcagtgagctgagattgcaccactgcactccagcctgggcaacagagggagactccgtctcaaaaaaataaataaaaataaaaaaaaaaaaacaaaaaaacaaaaaaacagaacatctggccattcaatatggtgaggagagcaaggctgtctgtaagtttccaggcatgacctctgtgtgtcccatcttgtattgctcagggactcaacaccagtttccagccctcacctcaattggggaaagcttcatgactactaatgagagacacctgatagagaaattcattttcaagtcattctcatgtatgtttcatgggttttggagctccgtttggctttgttactagtggcgaaaataaatacacaaggaaggtaacttctcaccctctatatgtttgaaaatgccggagacagtgggtttggttggctgcaagttctgtgtgttgtccaagtacagatgggagtcacctttgaaagtatcttcaaggttgaatgaactgatttttacttgtcattcattggtctataaaatgtgaataagtagaaagcatcttctgtttgctggtgcagggaggctcaggtctgggccgaggtccctatgtgttagcctaagtcaggtcaatgagaaccattttgggcgcaagacagtcctgggtgcgtgcagatgtgactggaggattttgtgtttttctttctatagtgtttattacaaagaaaccttgttaaatgacatccggaaagccagagagaaataccaaggtgaggaactggcgaaggagctagctcggatcaagctccgcatggataatactgaggttctgacctcagacatcatcattaacttactcctgtcctaccgtgatatccaggtatgaaatccacctagccgaggctcacgtatgctacgttcttccttggcttgaggaacgtcttgtgaagtatttgtatactcagtatgtggtgaagtggctgggttttgttcttcttttttgttttcttttttgagatggagttttgctcttgttgcccaggctggagtgcaatggtgcgatctcggctcactgcaacctcagcctcccgggttcaagctgttctcctgcctcagcctcctgagtagctgtgattacaggcatgcgccaccatgcccagataactttatatttttagtagagacagggttttcaccatgttggtcaggctggtcttaaactcctgacctcaggtgatccacccgcctcggcctcccaaagtgctgggattgcaggcatgagccactgtgcccggccagaggtggccgttttatagacaaatggtatgtggctaggtcataggtcatccagcttatctgttgtggtggaaattttggagaaggttttgtcacatcggggctggtgtgaccactccgacaagaagagatgtcataaacaggactgtttggcagaaggagccaagaatttaagtttatatgaactttacactaggcattgtaccaagccctttgacaaacctgaattcatttaatcctcttaacaaccctatgtgggatatgtgtactctgattatccacattttacacatgaggaaactgaggcacagagcggttaagtaacttgcccgaggtcacacagcagttggttaggtcaggattcagactgagactgatgctccgttgtccttgttcctaacccctctgctgtgcaacttcctttaggcttttgtcacttcctcctttgtttaccaccatacatcagtgacagggagaacaggagtagcagaaacacattcaggacccagggaatgtagatgtttattctgagacaagcatcagaagctactggagagttctgagactggtcttttggtctgtggttccgtgaaggaaattgagcgtttcctctctccaagttgaatgccattgagccatctctaaggatgtcttggcttcctttcctttggaggaacacaggatcacgtaccttactcatagaattccacaaagccatgttgagagttgttggctagaagtctttaaattgaagtgatggaggcgtccacttatgacctggaccaaaacagagtcaaccagtaaggaactcctgcccctggtgataaacagatgcagctagctgattttatttctgtttttcaaatttttatttatttatttatttattgagacacagtcttgctctgttacccaggctggagtgcagtggtgtgatctcagctcactgcaacctccgactcccaggttcaagcagttctcctgcctcagccttcccagtagctggaattacaggtgcctgccaccttgcctggctaacttttttaatttttagtagggatggggtttcaccatgttgggcaggctgatctcaaactcctgacctcaggtgatccatctgccttggcctcccagagtgctgggattacaggcgtgagccaccgtgcctggccagctagctgattttaatagcagttgctactagggatgataatgattaggtcttgtctcccaggacaagaacatgggaatgacttttcttgaagcctttcttccctcgagctgctgctttttgtccttcccttcatgtatcccttcttttcataaccttccattcatgctcaaaggtgggccaagaggttcttggaataccctgccttctccctcctggggcagcagcatcaaggcgcagagccacaggacaggcatggcatttcagtgggaagccctgttctgctgaccatggctggctgtcagcaagttggccagttccaacgattctaagcctggctgaaagagtaacaggcggcactgctaagaggggacttggctgagacaagcatggtcgcaatttttctccaggtaattatgcagagtttagagcagtggttctcaacccaaggacttttttggcagtgtctggagacattttcagttgtaaaaactaagtgcgtgtgtggggcatgaggtgggtggtgtgctgtggcttccagtgggtcaaggccagcatcctacagtgcccaggacagctcccacaacagagaattatggtccagaaacgtcactagtcccaaggttgagaaacactagtttagattaatgtatttgattctggcaaaataggaaagactggaatctatgtgctttgactggaagtttgcttgtgtgtatttgtccagctcactttaacacacatctctgctgatactgtttttttattttgtttttgattttgagacagacggagtcttgctctgttgcccagcctggaatgcagtggcacaatcttggctcactgcaacctccgcctctcaggttcaatcaattctcctgcctcagcctctcgagtagctgggattccaggcgcccgccaccatgcccagctatattttgtatttttagtagagacagggtttcaccatgttggccaggctagtctcgaactcctgacttcaagtgatccacccacctccgcctctcaaagtgctgagattacaggtgtgagccaccacgcccagcctctgctgatgttgttaactctcctacactcagctgtttcctggctgctggcctcatttacttttgttgcctttggatgcttcatgccctttgatagcagggattccttctctgttcttctctctctcatccatcttattttctggtctttttccctcctattaaaggctacaagtaacttcactaaatgccctttgtaaggaagggcctgtctttaagtgcggaggctgtctcctgtttataacaattcagaaaaatcagtgaagagctgtgtttcctctcttgctcactttgggacctcttgccaacaggactatgatgcgatggtgaagctggtggaaacactggagatgctgcctacgtgtgatttggccgatcagcataacattaaattccactatgcgtttgcactgaataggtaagaacgataatgtacgtacaggttttgaaacatgccacccattgaattgtgcttccttctttcattcaacatcgggtatgagccaggtcacgtgctaaatgccaaggttatgaagatggacaaggtccagtctttgtcctcagggactttgtatttggcatacacattctagctgtgagattgaacacatcaatccatcctaatagcttatgacggcatcaaaacaggcacccccggcttcacatatcttgtaacacatacgaggtcacatctcttttttaaatcggtaaaatttgcagtcagtgaaatgcacagatcttaagtatatgatttgtgtttgataattggctatacacatggaaacaacactcccatcaaaaaagaaaacatttccatcaccccagaagttcccttgtgctcctttgcaggcaatccttaacccctccataggtgaccactgttacagcctctgtctccatagatgagtttggcttgtccttgacttcacataaacggaatcacacagtgtgtactcttttgtgtcattcatcgtcgtgttcgcgagattcatctatgcggttgtgtgtattagtggtttgttcgttctcattgccgtcgcgtagtccttggtataggtatgccacaatcatctgttttactgctgatgggcctctaggttgtttgcggtttggggatactgagaacagcgctgctatggacattgctgtacatgctttttctacacatatggatacatttctcgggtatatagcatgtgcttgtagtagacatcggcaaacagtggtaggattctgattcctttttgggagaaagcttcatggtctctgtggaaatgcacctgctctctccccagcagcctttaaacccagcatcccaaggatgcattgttgtgaatgacggccagtcttcattaagcctgataaagtcttgtaactttgttcccccgacatagtaagctccattcttatttatatttacctgtgcttgattaataaccattaaatgagccatcacgcctgaggttcttgggagagtgcctggcacactgtaagtgctgtaaaaaattggtttgttaaataaaaactataagggccttttaagttactcatcactaagtctttttcccagacatagtagaggtaaccgttgtcagacagagaatgaaataatagattgccattttctcaaaataacaaaagagtaaaacaagatttgaaatggaaaattggggccggccgcagtggctcatgcttgtaatcccagcactttgggaggccgaggcgggcagatcacttgagctcaggagttcaagaccagcctgggcaacatggcaaaaccccgtctctacaaaaaaaaaaaaaaaaaaaaaaaaaaattagccaggcatgatggcttgtgcttgtagtctctcagctactcaggaggctaaggtaggcggcttgcttgatcctgggaagttgatgctgtagtgagccatgattgcaccattgcactccagcctgggtggcagaatggagaccctgtttcaaaaaaaaaaaaaagaaaaaagaaaaaaagacatagaaaattggtatttaggagaaacaggtatagcaggatgaggtgatcctgagatgaatacgtttcccgtttggaagcagaatggctgggattgcacaccagatagccacctttctctttgatgggtcttttccttctagtctgattatctcctgttagacagtggctctgtttaatagggccagacggggtctccaacactgagaacctcattttctccaacaaactaaggattttctatgggattgcaatacttgcttcatttacacatgtaatctgatcctgaatttcacatttttgctttaggcttaagttggccagccgtcaacatagtaggagtttgcattacacattgagcatctctaatctgaaaatctgaattgaaaagtgctcctaaatccaaaactttttgagcgccaacatgatgctcaaaggaaatgctcattggagcattttgtatttcaaattagggatgcttaactcgtaagtataatgtaaacattccaaaatctgaaatactgcaaatccaaagcacttctggtcccgagcattttggataagagatacctaactggtatatatagttttgagcgagtttatggcattactttgtatctgtaaaggggaaaatagtgatggacaagaaatgagttttcctgcatgaaggttgacctttagctctcaggaagtggagcaaatcatggccagaaatgagttactgaaggttggcagtaatggatgactttcgaccctcagatgtcaagggctccctgttagtgggaaagctggctcgagccggtcagctttccctgataccttccactccactgcgttcagaagcccattcaaagctacttcaagtttccactgagcagttaaactgcttgctgcttgatggcatggaatattttatgagtgatttgtatttgctgttgcttttacaaatggggctttattagatatatgaatgtagtcagaatattctgaccagggatccagccagtgagctggatggtctagaagaagaaaatcagaatcaaagtcccaggttcaaaacaaaatagaacttgccagtcgcaaaatagaaggcatgtgctcatattctacttccagcatctttggatcgagactaccaactctggcaaaatttacctctttgaattactcagcaagtggcagggcagttggatgtgtgacgcactgactggaatgtctaatatgtcgttctgtaaataaggggagtgctagatgagaatgctctgcagaccctagaaatgtgtgcaggggacatgagatgaacgtgactgaatccagcccacaccagaggggctgcatgcttgttccagaacctactgtattcacctgagccttagtctctgagcttcccagccgagagggcagagtgagctcgtcatctctacagtagccacgagcctccttttgtctcttctgttgatgttcgctgtttgatttcgctgtcttaatttccatgtggatataagtagcattctttatgacatgtttgtcaaatgtagaaaaatgatgacatcttcccacttttctaatgcattgtctccaggctcctaaaagcatcttgtgaaagaaggatacatacttgttgcttttctagtgaagagaaccacaaaatctgccaacttaaaaggaatcatttagtccaaatcctttgttttggagaggagaaagaaacaaacaaagaaaaaggcaagggcccaaaatgtaacacttggtcaataagagatctggaaccagaactccctccctaatgttaccacagcacactgcatatactacttttttttttttttttggcctgagacgctcactctgtcgcccaggctggagtgcaatggcgtaatcttggctcactgcaaccttcgcctcccgggttcaagcgattctgctgccttagccccctgagtagctgggattacaggtgcgcatcaccacgcctggctaatatttgtattttagtagagacgaggtttcaccgtgttggccaggctggtctcaaactcctgacctcaagtaatccacccgcctcagcctcccaaagtgctgggattacagacatgagccactgtgcccggccttggtttggtgtttattgtagcaaaaaaatacatataaaatttaccatcttaaccacttttaagcatatagttcagtactgttaaatatgttcacatatggtgaaacggggctctagaagttttcattttgtaaatctgaaactatgcacacattcattaaacagctgcccgttgctcccttccccagtccctagcaaccaccattcttctgtttctgtgactgtgactatcccaggtacctcatataagtgaaatcgtacagcactactgtccaatcttttggcttccctgggccacattggaagaagaattgtcttggaccatacataaaatacactaaccattgctgatgagctaaaaaaaaaaaaattgcaagaaaacctcataatgttttaagaaagtttacgcattggtattgggctgcattcaaagccatcatggaccatatgggccgctggttgaacaaccttgtacagggtttgtctttctctgactgctttatttcacttagtgtaatgtcctcaaggttcattcatggttgtagcatgtgtcagaacttccttttcaagggtgaataatccattgtatgtacagaccacattttgtttatccattcatctgtcgatggacatttaggttacctcttgagtattgtggatagtgctactattaacatagtgtgcaaatatttcttctagaccctgcttccaattcttttggatatatgcccagaagtaaaattgttggatcatatggtagtcctatttttaatttttttctttttctttttctttcttcttttcttttcttttcttttcttttcttttctcttttcttttctctcttctcttctcttctcttctctttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctctgacagaatcctgctctgtcacccaggctggagtgcagtggcatgatcttggctcactgcaacctccacctcccaggttcaagtgattctcctgcttcagccacctgagtagctgggactacaggtgcacaccaccacacctggcgaatgttttttggtagagatgggattttgccatgtttcctaggctggtctagaacccctgacctcaagtgatccacctatctcaacctcccaaagtgctgagattacaggcatgaaccaccatgcctggcatatttttaattttttgaggaatctgtaaattgttttccatcgtgcctgccccatttacatctcaccagcggtgtacagtttctccaatccttgccaacacttattttctgttttcctttttttttttattagctgccctaatgcgtataagatgatagcctattgtagtttcaatggacgtttctctgattagtgacactgagcatcttttcatctgcttgttggccatttgtatattatctttggagaaatgtctattcaagttctttgcccaattttttaaaaggttatttgatttttgttgttgttgagttgtaggagggtttttttttttatatatatatattctggctattgactcccgatcaaatatacaatttgtaactgttttcctatattgtataggttgacttttcactctgttgattgtatcctttgatgcccaaaagtttttaagtttgatgtctcatttatctgatcttcttcttttttttttttttttggaaactgactctgttgcccaggctggagtgcagtggtgtgacttccgctcaaggcagcctccacctcccgggttcaagcaattctcctgcctcagcctcccgagtagctgggattaccggcacccaccaccacgccagctaatttttgtatttttagtagagatggggtttcgccctgttggcaaggctggtctcgaactcctgacctcaagtaatccacctgcctcggcttcccaaagtgccagggttacaggcgtgagccactgcacccggccggatgtctcatttatctaatcctgctttgttgcctgtgctttcaatgtcatacccatgaaatccttgccacatgtatactttttataacaaaaagccagttgtattttttttttttgataaatgaaccatcttatcttctgagcagtggccttgccaataatacatgttatcttttaaaaaaatatttgcttaaagggctctgtcttcattgctcctcactggcctccttgagcccgtgatatcttccttttctgtttccttcttcagttccctcctttttgtccttcctcctttatttactaacttatttatgtgtcagtagaagggctgtgtgtaaaggaagagggttcatgaggggtgactgaagttaacaggtgattttttaaaaaatcacgttttcaagtccaacagagcttaaaggtaaaataaaaataaaaaattacacgtgtatatttctctctcacacacacctgaacttatacaaacaagtgaatttgtttgattcaaatgaatttcactgcagtgttctgcattgattttggcaatgctgcctttattcagaatattatggcatcagtcagagaggaatttttttctttggaattgccagctttctttatttttttcgtctcctctcccttttctcctgtcctcttctcctcctctcctctgttgtccaggctagagtgcagtggtgtgatgatggctcattgcaaccttgactttctgggctcaagtgatcctcccacctcagcctcctaagtaggcacatgccaccatgcccagctaatttggaattgctagctttcaaggcacataggaaatcaatatcattccaatgggttctgaagacagatttgggttccagttcctgcttctgtactttattgttatggccgtggtcaagtaatttaacctcctcaaacgttggtgtccccatttataaaatgtgatactgacatctaccatgtagtatcacttggagtactcctggcacgaagcaggtgcttggctattgctcttactattactgtgtagcttgatcacccatattttttctaccaggtttgagggataacttttgaccatttccaaataccaaaactactagcaaaatacagagattgccaccacagacaatatttaaaataacatacctttggctctgaaaaaaaattcttaagagaaatttatagaagtgcttttagcaccagaacatcgttctaataagtctctggccctctgagatgactattttgcgtgggacagggttgatctgaatataggtatttgcagaaaaaagcgatcgtttggtaaattcaaagtttattgatttagagtgggtttcttcaccttggcactattgatatttggagctggataactctctgtcatgggggctgtcctatgtatagtaagatgtttagcaacatccctcgtctttacccactagatgccaataccactccccccgcacctcacccaatgtaacaaccaaaaatgtctctagacattgataaatgtcccataggggacaaaaatcccttctggttgagaccactgatttacagggaggcatttgaggtatagaaaaagtgcacgctttgacatttgcatcaccaacaatatgatgttgtcaagctaattaaactccttcagcctgaatttgttcatctgtaaaccaggatggtgatgcctaaataagatatgccatatgcaaatgactgcacggcccctggcagctagaaggcagttcataaaagtttgatagctcctccatttatccctcatttacacttcttaattctaatcgggagataacctagtgttacataaaaagattacagagtcaacagggcgagtgccaagtggcttagtctgtaggaattatggttgcttaaagtagacaagaaaaactgcttgtaatgtggccaaaaagtggcccagagctcttaactggctgttggtcacccagagagcattcaacttggggaatggtttgagaaatactccaaaactgctctactgtttacaacccacaaaactgtggactggactgctgggaaaaaaaagtagaatggtgggaattaatttgaggctttaaaaattaaataatatcataagtaaaatattagcatagtgtctggtgcctagataatgttggatgaatgttaattgcccttctatttcccaccagagaattccaaccaccagtgttaggtcatctccaatgatagtctgaactgaaaacaatgttatgaccaagttttctatcagcctaagaaaatgcaacactgagagagctaagactaatgaatacaatgcgtaaaggactttaaaataaaatttttccatacctgacatcaaattttttcatcaatgagatttaagaacacagttccttatgtttttctcatgtataattttttttcggggacagggggggaccttcctccagtggtttaaggtattttttcccccataacagtaaagtcaaatacaggagacattgttttaacatatctttgtgactgggcatccagaaaattggttaacactgttaacagccctgccaattgctcacttgattgttttgaggctcatggtagcatgtattgcagttaccagcctcagatatcagttgaggacataaggactgggaatttatttgtaatacattttgacatgcagggtaaaccgttaattattaaccattcctgaggaaaatcctgacccatgtaagttgctaccagggcctccgcttggcactctgaatcaatcgcatgtggacattccctgttagctgcattgtgaagtcctcgttgccacgttgagtcaggaagaccaaactggaagttcaggagacactaaccctggaaaagctgccttctcgcccgctgcctgaggatttcaaacaaatgagaaaagccacagttccacttaggaaacattgactttcctgtagattcagcctcctacaccttagagcgggtgttgagagacttcacatgcgttcatccctgtcgctgttgtccttgagataaggacattgataaagagaaggtgggagacatcctttcagattttcgtgggtttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgcttttagccgggatggtctccatctcctgacctcgtgatctgcctgcctcggcctcccaaagtgctgggattacaggcgtgagccaccgcgcccggcctcgtgggtgagtttctaaagagacagaagggccactaaatcaaccctgtataacccccttctaaattcaggatggcaattcacattttactttagatgaaatattatcagtaagtgagtttggataatgcttcacttaagattcagaacagttgtgtttcagtgtgtttgaacactttgtagtatatcacagctcttatttcagcaatgtagggaggatacgtttatgcctgtgttgaaggacttgtaaagaaaggactttgtgttgtaggaaaagtgttggtttgagatttaggcagcctgtattctatcccagttctcctcctaactagctgggtatctgtgggcaagtcactttacttcccaggaattagtagaagtggacatacagaagacaagaaataaaaagggccaagcacagtggcttgcacctgtaatcccagcaactcctgaggtcaggagtctgagaccagcctgagcaacatagcaagaccccgtctctacaaaacaaaatttaaaaattagccggtgtggtggtgtacaactatagtcccagctactcaggagactgaggcaggagtagcgcatgagcccaggaggtcaaggctgcagtgagctatgattgtaccactgcgttccagcctgggccacagagccaggccctgtctcaatcaataaatcattaagtttaaaaaataaattacctaattaatttttaaaatatataaataaataatttttttaaaaaaaggaagggaaggctgtaggctgggtaccagttccagttgaggttgtctctttagttgtactccaggtgccagattacaagttcacccgatgccaccccgtgtatttcagtggttgatgtttgataagaccggaggttaagatgggctctgactacagtgaacagtccagtttagcctgactgaagggtttatttaggtgatagggagaaatagatggctgaggagggaggttggccccaggggttaaggaccttgactgataagctaaggaatttgaattttgttctgtagtccctagggagtaattactgaaggttttgtaaactggactgacatgagccaggttacgactccaccactatctgcatggccttaggcaggtcaccaaactttcctagacctagaccttatagtcatcttttttaaagagagagagagagagtgatttggaccagatgattttgaatattgctctcctttcaaaagttctgagtctataacttgaagcatcattttattagttgaatgattagagacagatcctttaagaccttgctttatgatggattctttatcctatcagcgatctatctcagtcctatttgttgttgtaaactcaattacgtcaccgttcccagggagaggaaaacctactctgtgtgctttctcactttgcttcctagtaacacgttataataacggagtttttccttaaacaataaaagattttgttagaacgcaggttaagtgaactaaaaggcacacatacagtttatttcacggccaaatgccaaattttcctcaaattatttgcccactacctcagctagtctctgtctagttttgttgctgttgctggctgattaatatttatttatttatttatttatttatttattgatttttgagatggagtttcgctcttgtcgcccaggctgcagtacaatggcatgatctcagctcactgcaatctctgcctcccgggttcgagcagttctcctgcttcagcctcccgagtagctgggactacaggcacctgacaccacgcctggctaatttttgtatttttagtagatattggctttcgctatgttggccgggctggtctcgaactcctgacctcatgagggtgatccacccgcctcagcctcccaaagtgcttggattacaggcgtgagccgctacacctggcctttggctgattaattttaaaagcaattttagtttgatatttccatcactaattttttttttttttttttttgagacagagtctcactctgtcgcccaggttggagtgcagtggtgtgatctcagctcactgcaacctctgcctcctcggttcaagcgattctcctgcctcagccccccgagtagctgaaattacagacgtccgtcaccacactggctaatttttctacttttagtagtgacgaggtttcactatgttggccaggctggtcttgaactcctggcttcaagtgatccacccacctcagcctcccaaagtgctgggattacaggcatgagccaccatgcctggcccctaatttttcttaataaaaacttttaatacatgtctagagtcataatctaggtctccccccaccccaaaacagcccctgagatacgaatttgggggcagatagtttatttgggagatgagcctaggaagtttcagaagggagacagggaaatgagatagggaaaagaagaaaggcagtagagggtatattaatgagcagatgaccactgtgtgggaaactgaggctgtatagtgttgaggagtttggggaggctttatagaacattctctatagaacaacatatagagttgtctcatccagtggacgaggaagctggggacctatccactaactctcagccatcactggttgagggctgccctgggggtgggacactcccaggggtagtggggagagggagaatggcagtggcactgggacccatcaagcctacaggtgagtggcagtgggatgctatcaggccattgtgtgtctttcgcacctactgcccttgtgggagttgatgttgttttaaatctctaatgccttctttttctgatcaactgtttttcttgaaatatcaatttctgaggagcttctgagtcttcctgtgttctgttttgtacagaattctggggagaatttaattttagtttcttgtagtttgttctgctctgcagaagatgccaggaatgatctaaaatatgtacacttcgagatctgttaccagaggtattgatgccatagttgcctggctactgtattgaagatttttccttgagatatttctttattcaaaagtggttctatttttttaatgcgtgattgagcggccaacgaatatcgttctgagcaggtagaaaagttttagtggcgtatctctggattttgcacacgtagatttggcttctcctcacagcagctcaggagaatcactgtagagagaaaactctcctgtgatccctccctttaagaacagatggcgatcttggctctgccatcaagccaaaggaaacatcagtgataaccatcagaggacctgtatgagatgagaaaattcctatgaaaaatgacctagacgcttactcttagcagcacactagaataggtctcgtggtgatcttaggtgacatgcactaaatattattttaacaacaatgccacttttcttgaggttttaaagaatagttgctcagcaagtcagatgaaaggaagttctcaccagcagccagcccttgggggattattcatggatggcaggaatgtgcagaaaaggattcaggagacatgaaggaactatccatgtgctagttttcctgtgcagctgggggtgtgaggatggcccggtaagtggagcacatttatggaaaaatggctattacttgggtatttgggggaaggcttcttgggaggagctagaatctggaaagccatttggagtgacatatgaaacctggagaatagctcctgagtcctttggagtaggaagttccttgattaggcagagcctttgagaaacttggcataagaggaatagaaatgactccatgtggcctggcccgtccctcccggtttgctcctctctagctgccctcatccgccttcagtcttagggcagcaggctgttctcagctgtggatgttagcatatgctgtgcccccgcccagaatactcgttccctcattgcttacctgactgaagctgatgatccttcagggtctagtttcagtgtctctttctgagaaaagctgatgttgcaaagaataccaagtctggaaaggatgttcctattgttactcattctcatagcgcttgctatttccctttatagcactccatttctgtgtttacttgcttaatacctatcatccctcctgctgtactataagcctgagggggcaggggccatggtgtatactaggccgtgatatagccagtgcctagtaacattgtgccacccacagagtaggcactcagtaaagatttgttgaatggggttgggcgcagtggctcatgcctgtcatcccagcactttgggaggtcgaggcaggcagatcacttgaggtcaggagtttgagaccagcctggtctacatggtaaaaccccgtttctactaaaaatacaaaaatgagccaggcatggtggcacatacctgtaatcccagctactcagaaggctgaggcatgagaatcacttgaacccgggaggcggaagttgcagtgagctgagattgtgccactgcagtccagtctgggcgacagagcgagactccatctcaaaaaaaaaaaaaaaaaaaaaaaaaaaagccgggcatggtggctcatgcctgtcatcccagcactttgggaggtcgaggcaggtggatcacttgaggtcaggagtttgagaccagcctggccaacatggtgaaaccccgtctctactaaaaatataaaaaattacccaggtgtggtggtgcgcacctgtaatcccaggtactcgggaggctgaggcaggagaatcaactgaacccgggaagtggagattgcagtgagccgagattgtgtcactgcactccagcctgggcaacagagtcagagtccatctcaaaataataataataataataatgataataataataataataataaaataaaagccaggcatggtaatacatgcctgtagtcccagctacttgggaggctgaggcaggagaatcacttgaacccaggaggcagaggttgcagtgagtcgagatcgcaccactgtactccaatctgggcgacagagtgagactctgcctcaaaaaaaaaaaaaaaaattgttgaatgggtaagtgaatgaagaagtgactaatgatcaactgtggtatagtattagaagagagccacataatgagtgtctgggtgctacagttaatttaaagtttggtagtagaaagtaaacgtattgtattttctttatttatatgtgagtctgtgcttaaaaacaaaaacatccaagtcagacatactcattgtatacagaaaaatataaaaacataattaccgttgataccactacccaaagataaccattgaagtagggtgtggcccaaagcagggaatgcagaaaagtagaggagtccacatgggctaggtcagggtcagtggtgatggaagtcttcctagcgtgagaatccctggtgtctgctaaaaaagggatttgataaaaactcagaggggaacagatcttcctgaccgagggaacccctgccgcctcggtggtgttgacttgtgtattaggctagtgtaactgttgtaacagacagccccacaatttcagtgacttcacatgatggaagtttcttttcactcatgcactattccaatgtggatgtatcctggctgggcagtctcttcttcaggtgatttcttggtgaactcagtctccttacatcttgaggctctgccctctcctggatcctcagatctcctttcagccagatgataggaaaagagcatggtgacttgttagagaggttttgtatctgtgtttggaacagctttgctgagatgtaattctcataccatacaattaacccattttggctggatgcattggctcacacctgtaatcccagcactttgcggggccaaggcaggcggatggcttgagttcaggagttcgagactagcttgggcaacatggcaaaaccctgtctttacaaaaaaatacaaaaaaattaaccaggcattatggtgcatgcctatattcccagctactcgggatggcttgagccctggagtcggaggatgcagtgagatcgtgccactgcactccagcctggacgacggacccaaaccctgtctcaaagacccaaaaaacaacccatttaaagtgtacaagtcggtgggtttttttagcatattcggagttgtacaaccatcactacgatcagttttagaatgttttcatcatcctccccccgccaccaaaagcccatacccattaccacttaaccccacttcccagcttccctcaattcttccccccctattcctaagcaatcactgatccattttggcaacctgttaatgggtaccccctcttcttccgcctcactctctagcctgaggaaaacactagtctcttttctgtctctatggctttgcctgttctggccatttcatataaatggaatcatacaatatgtgttttgtgtgtgtctggcttccttagcatactgtcttcaaggttcatccatgtggtatcatgtgtcaggacttcattcctttttttggcttaatattccattgtacagataggccacactttattaattcatcagttgatgggcatttgagttgtttgcacttttgactgtactagagagggttgtaggagcctgctcaggaagtgatgttcattacttctttccatgtttcatcggccacaagtcagtctcgtgtcctaatctcacttcaagggaacttgggaaatgtggtctggctgagtgcccaggaaaaaaagaaatggggcttggtgatgctgctacaacttgcaaataaggagtagagtttaactggatctatcagcgtggagattcctggtgacatgtcacagagcaggacagagagttcaggcaaggccactcttcagctcctgctgcctttgtgtgaatgggaaagccagcctgggaaatgcccagccccatcagagggcctatcagcccactgtagaccctggccttcacaggtggtgctttgccatcccaggagactgggaaaggttgggatgatggcagctagggtggatgatttcatggtgattgtgcctgatacataactgggtcctatttgtagagtagaaaaacaactattcggatctgtacgtttatttgactctgaacattgttcacactaagacacaggtcgcttctagttgttcccttccatgtatgtaaatacgaggcatctggccagagcagggcacctgctttcttgtggtaggtgtgtatttgtcagggtccaatcgggaaacaaagaccactctaagtatttaaaatagaagaaacttaatgtaggaaattggttacacaggtgatagaagagctgacaaaccaatcggaaatgatgaggcagccctgaagttagcatcagcaggaagctgctgtcacccgcttggctggagggacccagggaagaggtgatgttaccagagcccaggtgccaggatcacctggaacaatcgtgagccagcctggtgggagctgggtctaacaaagagatgtggctattgctggagtggccatgcacaccaagaaaaagtgggagaagaaactgcgctggcttcttccatcccatcctccagggcctcaccctctgcccccagtgcctcccaccggttgctgtcagctgagcacagcagcctagaggagtcagctcccctgtaacacaaagcagggctgcagaaaggccaagaatgcatttgagggcagaccccagtgattgccccagtaggacactattcagaattactgctcagtttctagtatttttaaagtcagctttaataaggtgtaacttacataccataggccgggcactgtgactcatgcctgtaatcctagtactttggcaggccgaggtgggaggatcacttgaggccaggagtttgagaccagcctggacaacacagtgagactctgtctataaaataaaaatgaaaaaattatcttgccttggtggtgtacgcctatagtcccagctactcaggaggctgagatgggaggattgcttgaggctgggagttgaaggctgtggttgagctatgaccatgccacagtattccaacctgggtgacagtgagatcctgtctcaaaaaaccaccatacaataaactaaaattttaagtgcacgatttgatgagtttggccaaataaacacacccatgaaactaccaccacaatcaagatatagaatattatatccctgtgttaggccgttctcatattgctataaagaaataccagagactgggtgatttataaagaaaacaggtttaattggctcacagttctgcagactgtacaagcatggcattggtgtctgctcagcttctggggaggtctcaggcaggttttattcatggcagaaggtgaaggcggagcaggcagctcatatggtgagagggagagtgagggccggtggcacgacctctactcactgcaaccttcaccttctgggtttgagcaattctcctgcctcagactcccgactggctaggattacaggcacctaccaccacacctggctaatttttgtatttttgtagagacagggtttcaccatgttggccagactggtctcaaactcctgacctcaagtgatctgcccgtctcggcctcccaaagtgctgggattacaggcatgagccactgtgcccggactcagtgtgatttttacatttgttggggtttttattgtcactacaggagtgaagacctttcacattcttctacatcttaattggaagcagaagtctcttgtaaggtttttgacaggtgacccaacacaaagtttattctagaaaggacactggtctaatgagaccttttgtgtgttaaagctcagggctggcttagaaggaggatttattgggattctatttgtctcttgccctatgaatttcctcttacagacacacagtatagaaaagagggccagggagacaggatggttgatggcaagtcagtgctctggcacacccatagctcatggcaatgctttgaggtaagcaaagtcagacacttcaggtgaaggactgaggcacagaagggctaagtgccctcctcaaaattcaattgggtaataaatggtgtgaaaatagccaggatctagctctatatgattcccaatccagtgttgtgtttttattctgtgcattttttacataagtaatagatgtgttggctcatgcctgcagtctcagcactttgggaggccaaggcgagaggatcacttgagcctaggagtttgagatcagcctgggccacatagtgagaccccatctctaccaaataaataaataaaaataaaagctaggtgtggtcatgcgtgcctgtattcccagcactctgaggcaggagtttcacttgagcccaggagcttgagcctacagtgagccgtgatcacaccactcagtgcattccacttgggcaacagagcaagaccctgcctcaaaaaaacaaaagtgataatagatgaatatgtttgtatattactgtgaaaaactgaaaaacaatccatttaaagcagttatccctctaaactctaatctcttgtcccgtccatattccggaagtaacctgtcttgtcagtttggtgtaatatccttggagacaattttctatgtactttacatactgtgaaaatatgtcatactgcagagtttttaaactataggaccacacaggaggtatactgttgtttttttcacatagtaatcgatgcttagagatctctccatgtcactacaataactgctcagttagtcattcatttaacagacacttattgatcacctactttgtgccagatccagttctaagtacagtagttaacaaatcagacccaaaaagtctccaccctctcggagcttgcattctaaaatggggagatagaataaaaaaaacctaaatgtattaaaacagtttagggtgatagggtagccagtaagtaggatgggaagattgtaattttaagttgagtgctcagagaagaccacacctattagaaagtgacatggagcaaagatcagaaagaggcaagggaacataccatgtggtatgtgggggaagatcatttcaggtagagggatcagcatgtggaacagcaaggaagcttgtgtagctggagcatagtaggtgatcggggcacaggagtggtaagagatgaggttggagaaataactaggaccacatcttgtagatccttacaggccattggaagaaaattggtgtttgctctaagatgggagccactggtgagttttgagtcgaaggatgacatgacctgccttacagcgcagaggatcactatgacttctgtgttgagactagatagtagagaggtaagtgtggaagcaggaaatgacatggcttggaccagagtggtaagggtgggctttatgaggagtgggtcaatttcagatgtagtttgaaataaaagccagtggaatctcctggtccaataaatggtgttagaggaaccaaacatgactgcaaagtttttggcctgagtaagaggaagaatggattggccatttaacaagaagaggaagactgtagaagaacaggtttgatgggacaatcaagagtttgatttggggccagccatggtggtgcacacttgtaatcccagcacttgaggaggccaaggtgggcagatcacttgaggccaggagttcaagaccaccctggtcatcatggctaaacgctgtttctactaaaaatgcaaaaattagctgggcctggtggtgcacgcctgtaatcccagctacttgggaggctgaggcatgagagtcgcttcagcctgtgagttagaggttgcagtgagctgagaatgcatcacaccattccagcctggatgacagagttgagactctgtctgagggggacaaaaaaaagtttgatttgggacacgttaagtttgaggtatcaacatgcaaatgagttgctgagagggcagttggatatgtgagtctggattttaggggagaggcctaggctggagatagaaatttggaagtcatcaaaatatggatggtttgaaaagtcatggcaatggatgatcaagggatctagggtagttaccaagaaagatgaaatgtccaagggtactgccaagggacactccaatgtgaaaagatcagagagatggactaaagtaggagaaaatcgggcgagtgtggtgtcctgcaaatcagatgataaaagtagtccaaggaggaaggggtgcacggttgtcaaatgcacatgtatgtgaaataggacaaggagtgagaagggagtggtggattcagcaatgatgccaacccactgacgcagaaagtccagcatgagaagcactgatgtctgggtctccagagattcagatttaagctcctaggtgattgaattttttttttctttctttcttttttttttttttgacatggcgtttccctcttgttgcccagactggaggacaatggtgcgatctcggttcactgcaacctccgcctcctgggttcaagtgattctcctatctcagcctcccgagtagctgggactgcaggcacctgccaccatgccctgctaatttttgtatttttagtggagacagggtttcaccatgttggccaggctggtctcgaactcctgacctcaggtaatctgcccgccttggcctcccaaagtgctgggattacaggcgtgagccaccacgcccagcctcccaggtgattctaatatgcagccaagattcagacccactgtcaaagtttccttctcttaattgtgaaatggccttaattgccagaaacagatgttgctggctgattcaacataggagtttttatctgtaggcttgttcttggataccttgggatctggaaatgataagcagatccaaaagctgattattaaccactaaagggattagctatttaacacctgtcttaaagtggcttttaagctgaaaatctctttgcttttaattttttcaaatgtttgatttttgttttgtttatactcaaaagactttttgttttgagtaacaagggtaaatttcaagttaatgagaaaattcaagggaaatcttgatgtaactggtccaaaaaactaaaatccaaacaaacctgagctcatatcactaattaggcattagcttgggcaacatggtgaaaccccgtctctacaaaaactacacaaattagccaggtgtggtagtacgtgcctgtagtcacagctacttgggaggctggggtgggtggatcgcttgagcctgggaggttgaggctgtagtgaaccgagatcgtaccactgcactccagcctgggcgaccctgtctcaaagagaaaaaaaaaaaaaaagcattcaagtgagtttattgagtttagtacattcttttcagaatcatgaatatttcacacctcaaaagttggctaattacagatgtagaaatgttgtgcctcataaaagtttcaatctttttcatattcttgccacagacattagaaattatttaaatgctctagtaaatttgagttggtatctgttggctcttaaaaattaaagaatattatacaatggctgtgcaacaagagatccagtttgcaggttagttcaattagattctatatgacaaaaagaggaaagataaaatatgttagaacaggatcaaggtagaaaatggaaaaagtccgagtcaaaatacaggcttaattattacaggtttccagaaggtcgccaagtgtctagattagccctttccaacccaggttgggttccacaagagaattaagtcctaatgcccgctggcatctattgtatgaagtgattgaatttctcttctgcatccggaatgaggctggctacgtaccatccttgggagcactgaaaaaatagtcactcaaataatcaaataattttttccagggattaattctgtcatggaaccccggttgagaaagtctggccattttagatactaatttgacatctgggatgatgcagtagtttttgaggtgcatgtcctcaggaaagaaaacataaaagagcctattgtggccgggcgcagtggctcacgcctgtaatcccagcactttgggaggccgaggcgggtggatcacctgagatcatgagttcaagaccagcctggccaacatggttaaaccccatttctccttaaaaaaaaaaaaaaaaattaaaaaattagctgggtgtggtggtgcacacctgtaatcctagctacttgggaggctgaggtggaagaatcgcttgaacctgagaggcagagttgcagtgagctgagattgtgccaccacactccaggctgggtgacagagtgagactccatctcaaaaaaaaaacaaaaaaaacctattaccaagaaattaaaaagaataatttattcacttattagaatggttattaataaaatatacccaggaccaccttgtataaatcccagcaatgattttctgaacattttaatatgtatccttacagacttttgtctatgtacattaacatgtgaatgtgtttatttcaaagaatggggtcatgcttttcatttagttcaggttttttccatgagatgttactgttacggatgttcctctgggtaattacacgtggatctgtccctttataatgattacgttattctgtagtctggttgttgcaaaatatattttgctgttcttccgttaatggacatctgagtcatctccagttcattactattacaagcagtgccataacaaacatctttgttcaaaaaattcttgaaaaaagatgtacatattacagattctagaagtggaatcgttgggtcaggatgggtacctgttttgtttttgtttttgtttttatcatgtaaaatcacaaatatatttaaaagtagggaatagtgtaattatcttaggcagggttctccagaggaacaaaccaataggatgtatagagatctagaggaagagatggattatgagaattgcctcaggtgattctagaggctggcaagtcccatgcaagctggagaaccaggaatgcttgtggtgtgatttggtctgagtccaaaggcctgagaaccagggatgctgttggggtaagtcctgaagccagaaggtccaagatccaggaactctgatgtctaagggcaggagatgatgaatttcccagttcaaaaaaagaaaattcactcttccttggcctttttgttctcttggtaccctcaatggattgcgtgatgccacctgcattggtgagggtggtcttctttactcagactcttgattcagatgctaatcttatccagaaacaccctcatagacatacccagaaataacgttttactagctttctggtcttccttagcccagtcaagctgacacataaaattaaccatcacaataataaacccccatctaccccatatccactttgataattatcattgcatggccaattttgttcccctttgcccccacccactcttttataccccaatgctggatttattacaaagcaaagacataccattttatccccagatatttaagtgtgtatctttaaaagctaaggacacttggctgggcacggtgtctcacgcctgtaatcccagaactttgggaggccaaggcgggtggatcacctgaagtcaggagttcaagactagcctggccaacatggtgaaacctctattaacattacaaaaattagttgggcgtggtggtgcatgcctgtaatcccagctacgttggaaggctgaggcacaagaattgcttgaactcaggaggtggaggttgcaatgagttgagatcatgccactgcactccagcctgggcgacaaagcgagactgtctcaaaaaaaaaaaaaaggttaagggcacttacaaaacatagtcatgattacattatcatacctaaaaatgaacagtttttaggttttatattatcatacctaaaaattaacagtttttctgtcagtgctcaaattttcccaattgtctttccttttcttttctttcttttttttttttttgttgagacagagtctcactctgtcacccaggctggagtgcagtggcacaatctcggctcactgccacctctgcctcctgggttcaagtgattctcctgcctcagcctcccaagtagctgggactacaggtgcctgccaccacacctggctaatttttgtagaggcagggtttcaccatgttagccaggctggtctcgaattcctgaccttaagtgatccacccgccttggcctcccaaagtgctgggattacaggtgtgagccactgtacccagcctcatatgttttatagtggatttgtttgaatcacagtccagactatgtatgttgcatttagttgatatgactcttaagtcttttttattatataggtttcctcttcacttattttttcatttccttatgatttacttgttgagatagaatcaagtagggactgagtgtaattgtataaggtttactggtgtggatcttaagcagtggctacattggaaaatgaaaactattatttagaaataatttttctgttaaagtacagcatccttgcacctgtctttcagcatgatgaatgcgtatatgtatttcactgtctttttaaaaaaaaaaaaaaaaaaaaaagcagggtctcactctgtcgcccagactggagtacagtggcatgatcttggttcactgcaacctctgcctcccagtttcaagtgattctcctgcctcatactcccaagtagctgggattacaggcgtgggccactaccacccggctacttgtatttttagtagagacaggttttcaccatgttggccaggctggtgttgaactcctgacctcaaatgatctacccgcttcggcctcccaaagtgctgggattacaggtgggagccactgcacctggcctctactccattgtcttgattgattcatttgtgaccttataacatctatctttcaggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtaaaccctcagcccgagttatgagcacttgcatctcttcaaggaacagaatcgcataggctaaggatgtgcatctcttccttatgtatatgtctgtctgttggcagggagcaaacatttgtagtaaatgtggtctgggaattttcagattccctttttgagagaaaaccatgagaaacagggttttctactggtcacactcttcccacaggtacacttgtttatgggccaagaaggaggcccagcacactccttccgagctcccacttccagagccttgtccaccaccaccagggcatcatcttcccagtgatctgttcattcattcacttattcattcatttatttaacaatgttcagtgatggcttactgtgtgccagaaacttttctaggtggtggggatacagacacaacggacgtgaatcctgcccttgggggccttgcattgctggtgagggaagttaaagaaagtgacacattaggatgtcatctgagggctatggggaaaggttaagcagggaaggggataaaggagggctcggaggggtggtctgcaattttaaatagggtagtcagtgaaggtgcctaaagatagaaaagtgataagggagtgaacttcacagataactggagaaagtgttcttggtggaggaaacagcaagggcagagactctgaggatgaagcatggcaggcacactccaggatggtcagcactaagcaaggggtgagtggagagcaacatgaaacaggaagagggtaagaccttcttgctctgagtgagaaggaacatcaaatggagggtttgagcagaggagtgacaagattggacatgcattttaacaagagtactcactgttatgcaaagaatatattttagggagtgtatcagctatcacttgctgcgtaacaaccccaaaacttagcagcttcgaacagcaatgattatgatttttcatgattctgtggctttgccaggcacttcttctgctggcttcacctgggctggcttctaaaactgaagtcagctgtagggtcaggtgtggctggaagatccaaatgaccccgtacacatttggcagctggtgttggctactgatactgtaccttagctctccaccatgtggttctaatcctggtagaccagctttcttacctggtatgcagaactctaagagagtgaacaagggagcagcaaagcctctagaggcttaggttcgggaactcacacgtggttacttctgccacatgctattggtcaaagcaaatcacaaggtccgcccacattcaaaagggtggaggaatgtgctccacctctggctaggaggaatagcaaagttgcattgcaaaggtgcatgcatattgcgatgggaggaatttgtggccattaaacagtctatcacagggacaaggacagaagcagggaacaggagaatatagcagtaattcaggggagagctggtggtggcttgagccagggtggtggggacaaaaatgttgagaaagttggatgcaggatatattccgaaggtggaaccaacaggcccacatcattcatttccatcataagagctcttgacattgctgttctgctttcattcaattctaactgcttcctctctctctctctctctctctctctctctctctctctctctctctctctctctctctctcttcctttcatacacacaggaggctctgtcctccccaccttctctccatccacacttacttctctgacaatcccagccactctcacacctagggacccttagctggagctctccaacccaacatcctaagtgatggccttacacctccccccctttgtccacctgttctacctcaagatgatgttgatatttcagactcaacattttgaaggctgaagtcatttactcttctccacaaggtatggcttccaatgtcttactttcttactactattctctaccctcctaggtctaaactttcagtcagtgttggattcattttgctcacttacctccccgtccagtcaggccccatttgcagcccttctgcgagccttctttcactgcttgccagtcctttcccatcaccactgcccccagtcactgccattttctttttaactttcttgccaggaatgttctaacagtacccaagtagactccctgcttgctgtctgctcagtctatccttcacagatttatagcttattcttcctaaagctcaagaacccaccatggctccctgctccctgctatataaaaattcagactctcagatcaccattctaggtgtcctgaacactttctccaacctacctctagccttgtttcccactacctggtgtgtgtccaactaaactgtagttcctaaggagttttccaaactcctgtctctgttcctgttttctatgctgagggctccctttccaaatcactgctgtttcatttctcttgccctttttttttctttttttgagactgagtctcactctgtcacccaggctggagtgcagtggtgtgatctcggctcactgcaacctccacctccctggttcaagcaattcccctgcctcagcctcctgaatagctgggattacaggcacatgccaccatgcccggctaatttttttgtatttttaatagagatggggtttcaccatgttggccagactggtctcaaactcctgacctcaggcaatccacctacctcggcctctcgaagtgctggtattacaggcgtgagccaccacacccggcctcatttctctttatttttatgccatatctcaagtatctaggtgagatagccctatatgtcttctgtgagttcctccagacttgaatttgtgtgattttaagataccatattcttgcttacattgtcactaattatgtgtagatcttattcccttccaccatagtgtaagtccttggaacataatgacctcattttctttttttaaatttccagtagttcctaatgcaccatgtggtggagaggagtcactcagggtatcgaagggaagttaatgtttggtaaagccaaaacagaaaactgtgttcccactatggtggtggggaattcagtccccaggtcagaaaatcactgcctttggttccttcaagaaagtcctaggagtttttctccagcggcttcagaaggtggtggcggtaggtgcagaagcaaatgaagcttcgtcttctgctcagggcgtggtggctgtggataagatctatcttggatatcatctaacccacactctccagtgcagacacggagcatatggctcagggaggtagggagctggtccaagaccacagggctggttagtggtgaatctggaactatggtcctgcctggagttcagatcttctctgcccctaagttgggcctgcttgacttctggaggagcaaccctttctgccctcttctcagtatgacttttcatagtagaagaaaataaaacagtcacatctagaaggatgtagaatttaaaattcccaaaacacacaggaaaaaaagggttgaattttgttgactaaggtaggaaggactttctcggtgtcctctgatctgagggtatttgtattatgcctcagaattgataatgccatattttaactgacttcaatgataacttctcctttcaagaattaatattttgttgttgaattctcttgccatcacataagtgacaaaattactactagcaagtctttggtataaatggtgccacttaaagacatttgtgtcattacttcattgagttctttttttcctgcctataattttcatactcgttcatagaacagaaatgaacttttcatgtatagaaaaagatgagagtgaaaatgtcactgttaacctttggtgtaaaaataggattcccaattttgtatcctgttgcttatcctgatatagtagatccctgtccctggcctcactttgccactgctcctatagttatttgggatccaggattttggcaatacggcttcctgcatgaaaaaacaactccatattgttaaaagcaaacaaacagcttgcagagaaatggcctaccattgatgccatttcgatgtaataaaaaatactcaatgcataattggaatccaactttagaaacaaggtttaggtgggcagggtggctcatgtctgtaatcccagctacttgggaggctgaggtgggaggatcgcttgagcccaggggttcaaggctgcagctatgattgtgccattgcactccagcctgggtgacagagtgagaccctgtgttttaaaaaatgaaaaaaaaaatgcataggtgtgtgcatgatggcacaaacctgtggtcctagctgcttgggaggctgaggtggaaggattgcttagatgcaggagtttcaggctgcagtgaactatgattacaccactgtactccagacatcaaatcgtggtgatcttttgggagtaggattagaattgattttaaatttcttttgtgtacttcatgatgatttccctattttatatagtccctgaggcttttataataaaaatcctatgagcaaaaaaaaattaaaactccctagtgtaagttactgtgttgctattatgactttttttttttttttttttttttttggagacagattctcgctctgtcacccaggctggagtgcagtggcacgatcttggctcactgcaggttccacctcccgggttcaagctaattctcctgcctcagcctcccgagtagctgggattacaggcacacaccaccacacccagctaatttttgtagtttttttgcagagatggggtttcaccgttttggccaggctggccttaaactcctggcctcaagtggtccacgtgcctcggcctcccaaagtgctgggattacaggcatgagccacggtgcctggcctattaagacatttttaaagttactagagagctgcatgtggctgttggtaaaggtggtggtgggaggcgaggggaatgggcaacaacaaatttagagaaagaaaacttttcatgagaaagttggtttataccattatttaaacattttttgttgtaatataataatactttggtggttctgtaattataggtatcgcaaagggtttgaactccagtcatccctctattcgggaattaatcttgcagttttgctgattgttgctggacaacaatttgaaacttccttggaactaaggaaaataggtaaagctgcttattattgcagatgttgttgctttgattatacaagtttggcattaaaagttatgttgaaataactagcattatatcattatatttctattctttttttgagacagagtcttgctcggttgcccaggctggagtgtagtggtgtgatcttggctcactgcaacctccgcctcccgagttcaagcaattctcctgcctcagcctcctgagtagctgggattacaggtgcccaccaccacgcccagctaattttttttgtatttttagtagagatggggtttcaccatggtggacaggctggtctcgaactcttgacctcaagtgatccgcctacctcagcctcccaaagtgctgggattacaggcgtgagccaccgtgcccgtactactagaattatatttcaaaaggaacaatcagttacttttcctatagcacacctgagacagcagccaaaataaaatacctgcttatcctcagtatgacagaaactaaaaaagattattctgactatcaaaaattcaaattcttaaggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtgagttgtgtctgtgtgttgtcatcacccatctcaatacatgatcttgttctgaaatgtcttccttataatcactatgtttctccttctgacttttcattaaagcaaagttagcacagacacaactgctctgagaattcccttgcttttatgtgaagggagggaaagacagatccacacagaatatatccctgcctgctccacccctgagattaggccttctattctattaatttctgcaggttgtctaggtcctcaagagaaaaacactcttggctactagtatgtattatgcatttgtgagaaagcatataataaaatgaaaaaagcacaccaagaaaatgtttatcacaaatgaaaactggaactaaaagaacaataatagggtatggtaaataaaacggtggcacagcaacagccttacacggccatttaaatgtgcaggaaagaatgtttggagatgtggaagtgtgttcgtggtttgttgtagagtaagaaaagccagtccccgggtaagtttttctgtatcagtggttctcaaattctgttgtgtgtcagaatcaacctatgttgattaaaacacagactgggtgtagtgacttatacctgtaatcctggcactctcggaggccgaggtgggaggattgcttgagcccagtagcttgagaccagactgggtaatagagtgagacccagtgtctacaaaaaaaaaaaaaaatagccaggcatggtggtgcacgcctgtggtcccagctactcgggaaggcagaggtagaaggatcgcttgagcctgggaggtcaaggctgcagcgagctgtgattgcacaactgcaatccagcctgggtgacagagtgagaccctgtctcaaaaataaataggtaaaataaagaaagaaaacacagattgctgggcccactctcagaatttctggcccagtaggtctggggtggacgcctgagaatttgcacttacaaattacaagctgctgctgctgctctggtgaccacactttgagaaccactgttctatatgatcttgttttaattaaaaatatgtgtttggcatgtgacttgtagggaaaggcccaggaggggtggacagtattggatttccccatagacatgaagctccgttagaattgtggtaacaaacctgcatgttgcacacatttaccctagaacttaaagcataaaaaaatatatatatatatgtatatatatgtgtgtatatatatgtgtatatatatgtgtgtatatatgtgtgtatatatatgtgtatatatatgtatatatatgtgtgtacatatatgtgtgtatatatgtgtgtgtgtgtgtgtatatatacatgatttgctggaaggactcacagaactcagaaaagctgttacactcttagttatggtttattacaatgaaaggatacagattaaaatcagcaaaggcagaaaggtacatagggtagagtccaggagagaccacgtgcaagcttccagttgtcctttcccagtggagtcatgtgaatagtgcttaattctcccagcaaaaatgtgtgacaacatgcatgaaatcttgccaaccagtaaagctcattgagccttaatgtccagggtttttattggggatgggtcatgtgggcatggagtcttcatgcagctgatattaatacctcagctccaacctctctagaggtcgaactgatacagtgtggcccagggccccgaagatgaatcatatcgttagcatagactatctgggatggcccaaggtcccagataaacagagatgctcttagctggcagtatatcccaagggcttagaggtgatctcccaatagccagtccagggccagatctttcttttgaatgtgtggagttgggacaacacaggcctgctgagtgcccaagcaagtcggttggagtctagctggcctatcttcccaggatagctccagcttttatccttaaagagcaaaataatactatgatgctttcagttgaaccattccgtttagtaccaaagaggttgtgaccaccactgcctggcaactatattccaaaaagttcagtttgcctgaaaagagcaaaggtgtggtcagagtcaagatgtcataacatcaaaatctacctagtcagattctaatatttcaaaaaataaaagacagtgagtttgactagtgattgccagaagtaagggagggggtgggatgggagggaggtaggcgtgatggtgggaaggcaacacaaggggtccctgtggggatggaaatttctctaacttgccttgtatcagtgacaacatcccggttgtgatacagtactatagttctttttttttcttttttttctttttttcttattatactttaagttttagggtacatgtgcacaacgtgcaggttacttacatatctatacatgtgccatgttggtgtgctgcacccattaactcatcatttaacattagatatatctcctaatgctaaccctcccccgcccccaccccataacaggccccggtgtgtggtgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcgtccttttttatggctgtatagtattccatggtgtatatgtgccacattttcttaattcagtctatcgttgttggacatttggcttggttccaagtgtttgctattgtgaatagtgccactataaacatacctgtgcatgagtctttatagcagcatgatttataatcctttgggtatatacccagtaatgggatggctgggtcaaatggtattactagttctagatgtctgaggaattgccacactgacttctacaatggttgaattagtttacagtcccaccaacagtgtaaaagtgttcctatttctccacatcctctccagcacctgttgtttcctgactttttaatgatcgccattctaactggtgtgagatggtatctcattgtagttttggtttgcatttttctgatggccagtgatgatcattttttcatgtgtcttttggctgcataaatgtctttttttgagaagtgtctgttcatattctttgcccactttttgatgggattgtttgtttttttcttgtaaatttgttggagtttattgtagattctggatattagccatttgtcagatgagtagattgcaaaaattttctcccattctgtaggttgcatgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgcataaggtgtaaggaagggatccagtttcagctttctccatatggctagccagttttcccagcaccatttattaaatagggactcctttccccattgcttgtttttgtcaggtttgtcacagatcagatagttgtagctatgcggcattatttctgagggctctgttctgttccattggtctatatctctgttttggtaccagtagcatgctgttttggttaccgtagccttgtagtatagtttgaagtcaggtagtgtgatgcctccagctttgttcttttggcttaggattgtcttggcaatgcaggctcttttttggttccatatgaactttaaagtagttttttccaattccatgaagaaagtcattggtagcttgatggggatggcattgaatctataaattaccttgggcagtatggccattttcacgatattgattcttcctacccaggagcatggaaagttcttccgtttccttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttagtggtgtataagaatgcttgtgatttttgcacattgattttgtatcctgagactttgctgaagttgcttatcagcttgagattttgggcgagacgatggggttttctagatatccaatcatgtcatctgcaaacagggacaatttgacttcctcttttcctaattgaataccctttatttccttctcctgcctgattaccctggccagaacttccaacactatgttgaataggagcggtgagagagggcatccctgtcttgtgccagttttcaaagggaatgcttccagtttttgcccattcagtatgatattggctgtgggtttgtcatagatacctcttattattttgagatacgtcccatcaatacctaatgtattgagagtttttagcatgaagcgttgttgaattttgtcaaaggccttttctgcatctattgagataatcatgtggtttttctctttggttctgtttatatgctggattacatttattgatttgcatgtgttgaaccagccttgcatcccagggatgaagcccacttgatcatggtggataagcttttgatatgctgctggattccgtttgccagtactttattgaggatttttgcattgatgttcatcaaggatattggtctaaaattctcttttttggttgtgtctctgccaggctttggtatcaggatgatgctggcctcataaaatgagttagggaggattccctctttttctattgattggaatagtttcagaaggaatggtaccagctcctcattgtacctctggtagaattcggctgtgaattcatctggtcctggactttttttggttggtaagctattattgcctcaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgcatctgtttgattcttctctcttttctttattagtcttgctagcagtctatcaattttgttgatcttttcaaaaaaccagctcctggattcattgatttttttgaagggttttttgtgtctctatttccttcagttctgctctgatcttagttatttcttgccttctgctagcttttgaatgtgtttgctcttgcttctctagttcttgtaattgtgatgttagggtgtcaattttggatcttcctgctttctcttgtgggcatttagtgctataaatttccctctacacactactttgaatgtgtcccagagattctggtatgttgtgtcttttttctcattggtttcaaagaacatctttatttctgccttcatttcgttatgtacccagtagtcattcaggagtaggttgttcagtttccatgtagttgagcggttttgagtgagtttcttaatcatgagtactagtttgattgcactgtggtctgagagagagtttgttataatttctgttctttcacatttgctaaggagtgctttacttccaactatgtggtcaattttgaaataagtgcagtgtggtgctgagaagaatgtatattctgttgatttggggtggagagttctgtagatgtctattaggtctgcttggtgcagagctgagttcaattcctggatatccttgttaactttctgtctcgtggatctgtctaatgttgacagtggggtgttaaagtctcccattattattgtgtgggagtctaagtctctttgtaggtctctaaggacttgctttatgaatgtgggtgttcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccgtttattttgagcctatgtgtgtctctgcacgtgagatgggtttcctgaatacagcacactgatgggtcttgactctttatccaatttgccagtctgtgtcttttaattggggcatttagcccatttatatttaaggttaaaattgttatgtgtgaatttgattctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgagaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgcagagagatcagctgttagtctgatgggcttccctttgtgggtaacctgacctctctctctggcttcccttaacattttttccttcatttcaactttggtgaatctgacaattatgtgtcttggagttgctcttctcgaggagtatctttgtggtgttctctgtatttcctgaatttgaatgttggcctgccttgctagtttggggaagttctcctagatactgtcctgcagagtgttttccagcttggttccattctctctgtcactttcaggtacaccaatcagatgtagatttggtcttttcacatagtcccatatttcttggtggctttgttcgtttatttttattctttttttctctaaacttctcacttcatttcattcatttgatcttccatcactgataccctttcttccagttgatcgaatcggctaccgaggcttgtgcattcatcacatagttcttgtgccttggttttcagctccatcaggtcctttaaggacttctctgcattggttattctagttagccgtttgtctaattttttttcaaggtttttaacttctttgccatgggttcgaacttcctcctttagctcggagtagtttgattgtctgaagtcttcttctcttaactcgtcaaagtcattctccgtccagctttgttccattgctggtgaggagctgcgttcctttggaggaggagaggtgctctgatttttagagtttccagtttttctgctctgtttcttccccatctttgtggttttatctacctttggtctttgatgaaggtgacgtacagatggggttttggtgtggatgtcctttctgtttgttagttttccttctaacactcaggaccctcagctgcaggtctgttggagtttgctggaggtccactccagaccctgtttgcctgggtatcagcagcagaggctgcagaacagcggatattggtgaacagcagatgttgttgcctgatcattcctctggaagttttgtctcagaggagtacccagccgtgtgaggtgtcagtctgcccctactggggggtgcctcccagttaggctacttgggggtcagggacccacttgaggaggcagtctgtccattctcagatctcgagctgcgtgctgggagaaccactactctcttcaaagctgtcagaccgggacatttaagtctgcagaggattctgatgccttttgtctggctgtgccctgcccccagaggtggagtctagagaggcaggcaggcctccttgagctgaggtgggctccacccagttcgagcttcccggaggctttgtttacctactcaagcctcggcagtggtgggcgcccctcccccagcctcactgccgccttgcagtttgatctcagactgctgtgctagcaatgagtgaggctctgggcgtaggaccctctgagccaggcgcgggatataatctcctggtgtgccatttgctaagaccattggaaaagcgcagtattagggtgggagcgacccgattttccaggtgccgtctgtcaccccttgctttgactaggaaagggaattccctgaccccttgtgcttcccgggtgaggcagtgcctcgccctgctttagctcacgcttggtgcgctgcaccccctgtcctgcacccactttccaacactccccagtgagatgtacctggtacctcagttggaaatgcagaaatcacccgtcttctgcatcgctcatgctgggggctgtcgactggagttgttcgtattcagccatcttggctctaccaaaaactgtactatagttttgtaagatgctaccattggagtaaacctggtcaaagatatatgggttctctctgtattggttcttagcacttcatgtaaatctaaaattacctcaaaataacatgtttaattaaaaagaaaatgagtttgaaattttgtcattttgtaattgctttgaactttgaactacagctgacccttgaacaatgtgggagttaggggctcagttgaaaattcaccaaaaacttaactacgaatagcctactgttgactggaagccttaccaataacataaacaatattttgtattttatattttgcaaaaagtgcaggattttcgcaaccactgacaactgcagtgacggcttcatgaatttccttttctgtttctcctacgatttttaggctggcttcatttatcttgaaatggcagcagccgtaactgcagaactcaatctgcaatacatatcaagcaattcaactttttctggtaatgtcatgacttttctcggcttcttgggagcatttccagtatcactagtggcactctctatgggtcccatggtgttattcattgtttatggtgtcacactaaatacaatgaagaatgcacgagaaccgtgagtgatcactttttactatgatctgcaatttactggagagacgaacttctcatgcaaaaatgatcagtctcacacggtggaagttttttttttttggttgtttgtttttgagacagagtctcgctctgttgcccaggctggagtgcagtggcacaatctcagctcactgcaacctccgtctctcagcttcaagcattccttctgcctcagcctcccaagtagttgggactatagacgcctgccaccgcatcctgctaatttttgtatttttagtagagacaggatttcaccatgttggccaggctggtcttggactcctgacctcaggtcatctgcccacctaggcctcccaaagtgctgggattacaggtgtgagccaccgcacctggccacatggtggagttttaagcagatacttacaacaggagctcaccacaatagcaacaggaggtggctatgaaattcttacagtagtgcagtatgcactacagttaattttatgcagttttgatataataccacatctttacatttgtttatatttttcttgactgggaatggtgccatatacagtctgtaagtgtgtgtgtaagttttggtacattttaactttttgtaagagatttgtatatatgttgggtagtaaatgataaaatggaccagtacctacatatattttatgtgttcatggcatacctagctttttctaatttttttttttatatttctaggcttcacagtttatctgcaaagtttttcaaattgtcgcacgtctccagaacattttccaatgtatctattgggaaaaaaaatccatgtataagtggagctgcgcagttcatacctgtgttgttcaagagtcagctgtgcctgcccttgttatttaaaacagttaccacatgctttccaatctccacattttaggcagtaggtactaaaattggggttagcacaatgttggtaaaaagccacgttgtgttattttgttggatggacttactttgcctactgctcgtgttttcttaattagttttgtggctgctgagcagtcgtttatgaagcactcatgacataatatgaatttaagtgaataaaagcttttggaaagcttcttttaaagggacttgaattgaattcagtttctttaggaatccaatatattgctgtttgtgatttttccaggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccagtaagatatgctaaatccatttttttttaagattaggaaaaaaactagggattggtgctatttaactattgaatactctgaactgaagaaaactgtagagtaattttaaatgttgggataaacatcaatcttatgtgaaatcagtaagtgatagatcagctcactcatagatcattggccatatcctctatagtagtcattctcaattggaagcaactttgtccccctaaggtacatctggtaatgtccggagacatttttggtggtcatgacttggggagaaggtggcactactggcatctgctggatagagaccagggatgctgttgaacatcccacaatgcacaggacagccccctccaataaagaattatccagcccaaaatgtcactagtgccaaagtggacaaactttcctctaaaacaatgtagcaccacgagtggaaacttggaattcagcgtggtttcctgttaagctttggtttgcctctaaggccactaattgatatttaaaagttaccaaaaaggcaaaattgcttttagcttttccttgagtttttgttttaatgttatgaccgtcttagagtcatgagtgaaatatgtgaatgtcttggaaattgaacttcagataattgtgttccatatttatgcgttgagaatttgtgaacatgccatttccaagaatttcattaagcatctaataaaatattgtttgaaatgattatgataattattttgttgccggttaataatacattttaaaatctttttttagttatgaaatatttcaaacctactgaaaggtacaaaaaaataatggagcagacaaccgcgtaatctctaaccaggtttagtgatcttaaacatgttgttttatttgttttggagatttattccctctctccctcctcatctcacccctcctctttctcttcccctcctcttttttttttttttttctttttttgagacggagtctcgtgcagtggtgcaacctcggctcactgcaacctccgcctcctgggttcaagtgattctcctgcctcagcctcctgagtagctgggattacaggtgtataccaccacacccatctaatttttgtatttttagtagagacagggcttcaccacgttggccaggctggtctcgaactcctgacctcaagtgatccgcctgctttggcctcccaaagtgccctcctccttctctcccgattttcttcctttggcctccttcttctctccttttccccttttctctttttcgtccccttctgttctttctccccaccttttctctccccactctcctcctcctcaccctcttctccctctctcccctcccctcctctcttttaacaaagtaacaccttactgatgggctatcacctctttttttatctcctttcatcttccccacccccccccccaagagatggcatctcaatatgttgtccttgaactcctgggctcaagtgatcctccgacctcaacctcccaaagtgctgggattacaggcgtgagccactgtgcctggccctcagtgaggatatattgagtacggacctccccgcctcctcgctgggcagggtgcgctatgttttctacccatgtacgttaacaggcatctgttcttgtttcaggttctggtcatagagccaaccaaagtgtaccagccttcttatgtttccataaacaatgaagccgaggagagaacagtttctttatggcatgtctcacccacagaaatggtaaggaggaaaaatcacaagcaatttaatcagttttcaaataggagagtctagatggtagtatttgaaggaaaaggcacccatgtttaacttctgaattatgagaatatatgagagagtatcatcacagatgagagacagtaggtttttccattttgtgtgtgtgtgggcatgtgtgtgtgtgggcatgtggtgaggtgtgggggtgggggagtgtgtgtgtgtgtgtgtgtgtgtgtgtgtataaaaacattaaaacaaatacaggttggtttgtttttttatagttaaaccttagggaagtgggtagaggatacaggctggtgtgttgtttcacagctgtagtcccaacacttttggaggccaaggcaggcgggttgcttgagcccaggagttcaagaccagcctgggtgacacatcaaaaccccgtctctataaaaaataaatttaaaaaattagccgggtgtggtggtgcacacctgtagtcccaactacttgggaggctgaagtgggaggatcgcttgaacctgggaggtcgaggccacagtgagctatcattgcaccactgcactcgagcctgggcaacagtgagaccctgtctctagaaaaataaaatagtaatatatttttagaagcacttatactggctttcttgatattcctcaactattactggatcctgtggctttccagataaaactcagactcttttactaagtgttcaagtccctccctatataatcctgccccctcccttcctctttctcttcagccctcagtgccagtcaggctgtcctcttactcgcccctgagctgtccctgcgggagctcctgtctaccctttcatttccatccttgttccttttgggatttccttcttccgattatccaagtcctagcttttgcaaagtcatctttaaccactccttcattccttccgctgagtgtctgtaggctaccaattgcctgtatcatgcacagaagaacatcctaagaatgcccatacatgacttgtatgtttgtagctgtaggagctatggaacagttacccactcctgaacaaatgcctgttgattattacataaaatgtgttgtttacttaactagtaaatgttcctcccaaatcaagaagttctctaaagccaccgtggaatagacctgccattggggaagtctttggaaactcatgtggctaagctttctgtatatgtgcagcctcctgcaggtggctgtgggttagacaagactcttgagtctgccctggctcccatttctgtgcctgaatccaaaggccgactcctgctgtctgccactatcctctctgcatgactttggactcatgtctcctctgaagtacacttagcctttctatgcagttggatgtgatttgctggctttcatattctcctaccctcttatgagaagcctccagtggcttcctgtctcacgcagagtcaaagctgacatcccgagggtggcctagaagtcctgcatgatttgcccatgagctctccaacctcctcttctactcccatcccgctcactccactgtagccatatttgcctctttgttggtccccgaacgtgccaggcacacccctcctcagggcctttgcacttgctgttccctctgcctggaactcttcccccaggcatccacgtggcttccttcttcccccactttagctttctgttcagaagtcatcagcgacgcctaccctgaacatcctgttgaacaacgtgaccccctgccctatcttaatgcccttccctactttatttgtcttcataacacttttcaccgccccccatggtatgattttactatttaatctattgtccatctctcttcactcacatgcaaggcccatgagggcaggaactttgtggttctctgctgtgtcttcagtattagtactttgcctagcacatacatagtaggtgcttgatcaacacgtatgactaaaacttctcccatcggaaaccatcttcccagtctgttcctgttgtcattgctccaggatggcaagaaactagtcatgtgcctattcatggcagttctcttgagccaaatgctcagtcacatggttctcatacttttcttccctgggtggcttagttggtcacttgtgacattcctcaggccaaccaaatggaatttttttttttttttgaggcagggtctcattctgtcacctaggctggagtgcagtggagtgattttggctcactggaacctctgcctcccaggttcaactgattgtcccatctcagcctcctgagttgctgggactacaggcgtgtgctaccatgctcagctcatttttgtatttttagtagagacggggtttcagcatgttggccaggctgatctcgaactcctgacctcaagtgatcgcccccacacctcggcctcccagagcgctgggattacaggtgtaagccaccacgcctggcccaaatggattttcctacttaaaattattttctgcaattgtgatgtattgatgttattgcctatggattttccaaaactggagtttcagatgttccttctcaggcttagctttgtgcaaagtgtagtggtagtgaagggaggggaccgagttagtttttgtttgtaagtgcaacttgggtgctgtttgaaatcccagttagtttttttattagtcatggtaggctagcttctaaaacaaacagcccccaaatctcaatatcttaacatgataaaagtttatctatgcctcatgtcatatccaggttgcagagggtggcggtggggggcattccatcttgcagtggatggggaaagaggaaatagagggttgctgtggagtttttgagtcaggcctgcaggtgatgcacagcattcctgctcacatcccattggccaaaactccactgtatatctctctagctgcaagggaggctgggaattgtagttcagctctatgttcagggagaaaaggaagactgatgaatgctgaaaggtgtctgtcgcagtcttgcctctcccaacatttttgcaagtcactcaacttaggtgggctagtcccatgcttgttttagagtttgcctactatgttgacagaagatgaaaagccactcactgtgtgtttattctatgcttattatttctatctgaaacttagattatttcaaatttacatcatttaaactggattagagatacaaatgaatttttataatacataagaaaatgtttctggtgttccatgttatacaaggtgtattgctgtaacccgtaaaaaaatcaccactgcaggtaaaatagcagaaatgattgaccatagaatgaaacaaaaaaaatcatttgctttaaaaaactcaaactattgacttctgtctttgataacttgcagaaacagatgcacgaatggaattttacagcctcttccataaagggaataaggtaagaacataggagaaaatggagttactattttaatgcaaatgatgataatgttttatgcactttaatgtttccacttactcataatatggaatgttcttatttttaatggaatccaaagtggactctctattatgttgtccttcctgagctagttattaatactagtgtactcctagtgagaacttcttgggttattataatagagtagctttgctcatattcagcagactaaactcacttgtgccattttttttaaagaagtgatcggtaggaagagaagatgtatcttttttgagccaaagatgttcaagtgctcagtgactctgagaactgaagccaggagatgattagtggcaacactcgggttggggtcttgtgaacagagtaatggagctgggagatttttttcagggagggcatgaggtggtgtattctcgggagaggagtagctcttgcattttggttcaggagtgatgacagtttgagcctgagctgtgtggccttacccaagcagggctaaacatctcagctgcacttgtcaccctggcagctcattcgagggtgagactggctgtgaagtagatgtgagttctaatctctctttgctgggtgatgttaggaaagtcactcagcttctctaagtctcagtttcttccctattttcttcaaataaagggcttgtactagaacattcctttctctgactctgaggctacctcagccactgaatgaatccccagttacttctagacatagtgtgatcctgtcctggaaacatcagtattgaaattaggataccatcaacatcacttaaaaggagggaaataatttaagtacaaagtagtgcattgggatgatactgcccaggaaatacaaggcaatttgaaatacactcagcaaagcatacacaaagcagcagaaaagggaataaaatatggtctctgtcctcaaggagtttatagtctcatgaaaaggaaaggtaaggtatttgagaaataatttattgtggtattacaagaatttctagactcggaaaatatcaggacacagtatttgtggccacacgagggaaatggaaataaacacggcactgtagctcaagaaaggcctttctttaaatgttatctggtccatctccacccagtgtgtgtacctgactctacagctcatccagcaagcaatattcagcttgcctgagcatagctagtgacagaaaatctgctagtaaaatatgtatttttattttttaaattattttattttattttatttttttgtcttgctctgtcacccaggctggagtacagtggcacgatctcggctcactgcaacctctgcctcccaggttcaagcgattctcctgcctcagcctccagagtagctgggactacaggtgtgtggcacaatgcctggctgatttttgtattttttgtagagtcagggttttgccatgttggtcaggctggtctcgaactcctgacctcaagtgatccgcccgcgtcagcctcccaaaatgctaggattacaggcatgagccactgtgccttgtgaagattttcaaaaatgtgttacttagtaattaagttgtgttagagcaggtagtcaagatccttctgtttgtgcctcctcatagagatacctctaggtgccatttcagccatcagtggggatttacaaagggcctgagggcgtatcatcctcgccccacccctccccgggacccatgtgacctgaagagtatactttgagcgttccagaggctctccaactaactgtggtggttgctttacagattgattttcaaaacctgctcacttataatctagttctaattctttttgaatctcctctgtactcttggtgttccaacccagtgtttgtcatgcaatctataacataaagaatggtctaggacagtttggatctcagcaagagataacttagaaaggatgagataaagtggcttcagttgtttgaagggacaatgatagaagagaatctagccttcctctccataatacctcctggcatgagggccactgctctctgacatacaatctactagcagatttcctgtcactggctatgtccaggcaagctgaatattgcttgttggatgagctgtagaatcaggtacagaccctgggtggagatggaccagataacaaacatttaaaggcctttcttgagctacagtgccatgtttatttccatttcccttgtgtggccacaaatactgtgtcctgatactttccgaatctagaaattcccttaataccacaataaattatttcacaaataccttgcctttctttttcatgagattataagccccttgaggacagagaaccatattttattcccctttctgttgcccgtatgctttgcttagcactgaattatattaagagtaagttcatattaaggtcagttgataaatacaaactcaaatataagcaagataaatgtctctggtatttaaatttcatagagaaataaaaggcagactcggggggtgtttgtttaaaacattaatgaatctttcaggaattgataaaatagaagaaaagattgtcttgcagatttagagtgggtatcataacttatgtataaacattatgctttgaaattttacagcctatcaaagtttgatgaaaggtgttgttttctttatgtccatgataattctgatgactttcaaatctacttttccaccgaagagcagtgcagtaggtgagttacagccaattcaggtatttgcaatgtaattatggcgaatcatttttaaagggcctttgttctgaaagatatttacttgctattactgtctttcttgaaatgttaacttacatctcaaaaaagctctaaaatttctgtaattcacatagcaggtaattcagccatttaaaatacacaacttggccaggtgcagtagctcacgcctgtaatctcagcactttgggaggctgaggagggtggatcacctgaggttaggagtttgagaccagcctgaccaacatggagaaaccctgcctctactaaaaatacaaaattagccgggtgtggtggcgcatgcctgtaatcccagctacttgagaggctgaggcaggagaatcacttgaacccgggaagtggaggttgcagtgagctgagattgtgccattgcaccccagcctggggaacaagagcgaaactccacttcaaaaaaataaataacataacattcagcattttttagtatagtcatagttttccaaccaacaccataatctagttttagaatattttcgtcacccccacaagaaacacactatccatagagtcattcctcattccctcaacctcgccccatcttggccccagccctaggtaaccattaatctttgtgtctctatggctctgcctattctggccatttcatataagtggaatcatacagtatgtggtctcttgtgactggcttctttcacttagcgtaatttttttaaggtttatccatgtgtaacacgtatcagtacttcatttctttttgtggctgaatgatattcttttgtatggctataccacagtttatctgtttttcagccaataggcatttggattgtttgcactttttgacaattatgaattgtacttccctgaacattcacgtgcaagtatttgtgaggacatgtttttatttctcttggagtcaaattgctgggtcttatggtaactctacgtttaaccttttgaggaactgccagaccattttcccattttatattcccattagcaatgtatgtggcttccaatttctccacgtccttgccaacactagttattatctgtcttttgagtattgtaatcctagtggatgtgaggtgggatctcattgtggttttgattcgcattttcctgacgactaatgatactgagcatcatttcatgtgcttattggccatttatatacctctggagaaatgtctattcaaattcttagtccaattaaaaaaattaaactttttatttttgaaaatatttacagccataggaaagtttcaaaatacaatacaaagaatttccatatacgtttcacacagaatttctcagggtttaccccttaccacattggttttacattctcgctctatgcatatggttattttttctgaactgtttaaaagtaagttgtagacaatgctccattacctgtaaatacttgagtgtatttcgtaaaaacaaggatactgacttgtgtaattacagtacagttatctaatgaggaaattaagatagatatagtactataatctacaacatttatccaaattttacttagtgtcccaatgatgtcttttatagcaaaacaaaaggtttttcctctggtccacgttccaatccaggatcacatgttgcattgagttgtcacgtctgcatagtctcctttcacctgaaagagttcatcatcagtctttgtcttttttgacttaatactttccaagagtacagacagtttattttgggtagtcctttgacttggatttgtttatcgtttcctcatgagtacactgatgttatgtatttggcaggaatatcacagaaatgatgttgtgtccttctcagtgcctcataacaagggacacaatatttctgtgtcatcattggtgatgttaacgtggatcatctggtgaaagtggtgtttgccagctatctccaaactttgcccacttataattgggttatttatcattttattattgattttaagagtgatatatacatatatatgtgatatattttttctctatgtaagttctttatcagatatgatttgcaaatgctttttcccatcctgtaggttgtcttttcactctctcgatggtatcacttgcagcacgaaagtttttaatttggatgaagtacaacttacctatttatttcttttgtcatttgtgcctttggctcttgtcttagaagctttgtctagcctgaggtgttctatggtttttatgttttcttccaagagttttatagttttaacttttatatgtttaggtttttgacccattttgaattcatttttggatgtggtgtaaggtaggggttccaactttattctttaacgtggatatgtggttgtcctagcaccatttgttgaaaagactattcttgaaaagactattctttccctgattgagtggtcttggtactctttttggaaatcagttgaccacaaatgtaggagtttatttctggactctcaattccgttccattgttttgtatgtctattcttaatgcaagcaccatgctttctctattactgtagctttgtagtaagttgtaaaatcaggaaatgtgagccctccaacttcgttcttgtttttcaagattgttttggttattgtggatgcttgcatttccacgtaaatattaggatcagcttatcaatttctgtagaaaaatggcagctaggactttgacagggaatacgttggatatctagatcaatttggagagcattgccatattaaccatcctggcttccaatccatgaacacaagatggatttctatttacttaggttttcttgaatttctttcaatgatagttttgtagtttcagtgtacaaattttgtacttcttttattaagtacatacctaaggattttattattttgatactggagtttttttaatttcacttttggatgttcactgataatgtattagaaatacacttgagttgtaaatgttgattttgtaacttacaaccttgctgaactcatgtattagctctaatgggttttattgaattccttagggttttctatgtgcaatatcatgtcatctgcagatacagttttagtttttcctttccaacctagatgcctttattttccttgcctaattatcctagctagactctccagcacaatgtggaatagaaatagggagagtagacatctttattttgttcctgtttttaagaagaaagaagttagtctttcatcattaagtatgatgttagcagcagatttttcatagataacctttatcagattgaggaagttccctttattcatagttcatttgtatcatgtaatttgagaaagtcttaattcattgtgtctcagacaatcattgtcacaacatatttaaagattaggctaggctgggtgtggtggctgatgcctgtaatcctagcactttgggaggctgaggaaggaggattgcttgagtgggcagttcgagaccagcctgggcgacatggtaaaaccccgtctctgcaaaaagtacaaaaaaaaaaaaaattagctcagcatggtgacatacacctgtagtcccagctactcaggaggcagaagtgggaggatcacctgagcctgggaggttgaggctgtggtgagtggtgatcatgccactgcactccagcctgggcgacagagcaagatcctgtcaaaaaaaaaaaaaaaaaagaatagaataaatagcagactagggaatcattggatcataaccttcaatttacagtagaaaaaatgctgccaaatataaattggtgtaaaagtaattgcagtttttgccattaaaaacctaatattaagcagaacatccttttactactacaaaatgtgcccttttgaccctcattcagtactcagtgcctttttttaaaaatacattttaataatttttttattgatgtgtaacgtataaacaagtttgtaatgtgcacttaagtgtacagcttgataaattttgatacatatatacattcttgtacctgcctcccagatcagcaccccagaagttgctttgtgccccttcacagtcattaaactccctccagtgataactgttttgatttttaccaccaatggttagtttcacctgttcttgacctacaaataaacagaatcatgtagtttgtacccttgtttctcacctctttcccttaaaataatattcatagctgggcacggtggcccacacctgtaatcccagcactttgggaggccaaggcaggaggatcggttgatcccaggagttcaagaccagcctgggcaacacagggagaccctcgtctctacaaaaaataaaaaaattagctgggcgtggtggtgtgcgcctccagtcccagctacttgggaggatgaggtgggaggattgcttgagcctgtgaggtcgagactgcagtgaaccatgatcacgccactgcactccaggctaggtgacagagtgataccccatctcaaaaacaagaaacaaaatgaaatccaactgtgaagtatatatcagttcattctttctctgtgtagcattccgttgtgttccaatttatctgttcttctattaatgaagacttggattgtttctgtttgggggttattatgaagaaaatgactatgaacattcttatatatgccttttggtgaacatatatattgatttctattgagtatatatctaggagtggattactggattatagggtaggtttatcttcagctttggttgttgatactgccaagagttttccaaagtggtcatgtcaatttacactcccactagcaatgtatgagagtcccagttgttccgtattcttaagaacagttgatatcatcttttattttttttctgttgagacagagtcttgctcttttgcccagctggagtgcagtggcgcagtcttggctcactgcaacctctgcctcccggtctcaagcaatcttcctacctcagtctcctgagtagctgggactacaggtgtgtgccaccacacctggctaatttaaaaaaaaaaaaaaattgtagaaacggggtttcggccacgttgcccaggttggtctcgaactcctggcctcaagcagtcttcccgcttcagtctcccaaagtgctaagattacaggcatgagccactacacctggctgataccgtcttttaaatcttagttgttctgtgagtgcataccatatgtctcttaagaagcctgacgattgggttatccagctttcaaagattagaagaaaaggtaagatgggttagttagaaaaaagagcattttaatggtttatggaaattatcctgaaatgtacagtattcctccttgacatcttaagagagaattgtgagtaaaaatgttctaatgagtcaagatgacttgtatccaaataaaaactgcacaagtctaggaagtggcccacgtggcccagtagaatttgtgagaaagatttatgggtcaatattaagcttgttctgtgtcagcagaatgatgtggccaccttatgcgtttcctcctcaccattccccttatacaacaccctgtatcttactgagaactagattgtctgtactttgagaggcaatagtccccctatccttagcattgattagatcccctctgaacactggtcttggggccagacttcaagaataatacaagaggctgggtgcgggggctcatgcctcccaacactttcggaggccgtggtgggagaatcatttgagtccaggagtttgagaccaagctgggcaacatagtgagaccccgtctacaaaaaatacaaaaattagccgggcttggtgatgggtgcctgtagtctcagctgcttgagaggctgaggtgggaggattgcttgagctcaggaggctggctgaggctgcattgagctgtgatcacatcactgcactccagcctgggcgacagagcgagaccctgtctttaaaaaaaaaaagaaaaagagtaacacagggacgtcatctgaagaattacctgctagtagagtaactcacacgtcctggggaaaacagtgatgggacagaaaggaaagacttatagggacatggtaaaattatgtgcacttctaatggggtgttaagtagaaaaatggttaattctaagcaaactgtggatggaacccacatgaaagaagtctttggttcagtaaaagggaaatatttctcattaagatcttccaagaatgagctgtctttgggaggtaatgagttctctgttgctggaggtactcaagcatcaattggtcaaccagttggtggagatactatacagaggggattcaggtatcacattggtagttgccctagatttgataaccactaaagtaccacgtcaaatcaaggaggggatcgattgttccatgacttgtaaaagtttggtttatatttaagtacagtttaataaagctaagttaaaaacaaggaatgagagcagttctgagttggcaacgtatttgtgacacttgctgttctagatttttctctttggtcaaagagatgataaccaatacagcaggcagtacggtggagctggagggagagaccgatggagacaccttggaggtgagtcatggacgatctagaatatggaaaacattgattgtgtgttcgatgcttcaagaaaatgtcccatctttctataaaaatcctctgttgagtatgttttatgaacctgccagccatcactgcatggttcccagagataatgttgaatgtgtctccagagaagaatctcatttctttgggattctctcagttagaatgcttaagaaaaatttggccatggactagactaaaatttccttttgtgaacaacctatgaaagttttctctaggctaattagtaatgtctgtgagactacaagagaattagttggccaactgagagcagacgttttatgcttaaaatgactttagttatagctatgtgcatatactatatgaaatataacaactttaaaatcattttaaaaagtaggctcatcagctctttttaacagcacagttatagtccacagttgctaaaccattgtacaggtgtttaaatcttgcccagttattcagatttgccactcactcaggttcttccagtgattacaatttaatgagattttactgtactttcaggttagactgaaaggaattccttaatgtttctttcagaaaatatcaaagggattcattttaataattgagttaactactagaattcttaggtcaggaccagagtttgttgtagaaatgaactgagcaatggtgctttgagggcagcaggtgtgggaatcggagggaggtgtgaggtaaaagtcttctatggagcaggctgattgccagttacatcagacactgatggagatcctttactaaccatgtttttttttttttttttttttttttttggaaacagagtctcacgctgttgctgaggctggagtggagtgcagtggcgcaatctcgccttactgcaacctctgcctcctgggttcaagcgattctcctgcctcagcctcccatgtagctgggactacaggcacccgccaccacgcctggctaatttttgtattttatttatttagagatggagtcttcctctgttacccaggctggagtgcagtggcgtgatcttggctcactgcaacctccacctaccaggtttaagcgattctcctgcctcagcatcctgagtagctgggaccacaggcacgtgccaccacgcctggctaattttttgtatttttagtagaaacgggatttcaccatgttggccaggctggtctcgaattcctgacctcaggtggtctactcgcctcggcctcccaaagtgctgggattacaggcatgagccaccacgcctggcctaatttttgtatttttagtagagatggggtttcgctatgttggccatgctggtctcaggtggtcctcctgcctgggcctcccaaagtgctaggattacaagcatgagccacagtgtccagccaaccctttagtaatcttaattgtcatgaacatccctagaagtagatgggaaaggacacccacatacccgccgactattccgtgtataagctgcacttctgtaagtagaagcagtggagcatgcaaaataacagaaaaaattgattgctgcctctctgctttaaataagtgttgctcagcgtacagtcacatttgttttaatcatcgagaagaatcaaatgcatctgtatgtgacagcttttgatgggaagatgggggaacaaaatagtaatgctaattgtaaatcaagtttttgtactaggtgtttactactagatccgtatgcctgaaagagtggggaagccccagcatatttactttttgtattaagataatgttaattatattgaccttcaattcctttctgggttattgaaagatatttgtttcctgacaacttgataagggattatgcaggaagacacctagttgggttattcaacatgcttagaagcagttttaaattgcagcgttaaaatggggaagaatttccaaaaggtgagccaattatatgcaaaccatatttttaattttcttggattccatttcataaagtcatactatgaacaggtgaacaatggagaattctgcccctttaaagtcatttaatgaaaagggcctaagctaagcactgtgacttgcctgacagtcaaataatgttatttatattttttttagttgctagacaactctgggggccttagagggcttctccgctacaagttgtatgcttttttgtccttttgtttttccttcttcagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggcaagtccaggcgggccttccgcatttcgggtgccgtctccacaccccagatcccatacccaccgctcatggtgtggaggagttaagggcaaaagcattgtgttaccacaaaacctgtcattctcttgtaataggggtgatcttttttttttttttttttttgaaacggagtctcgctctattgcccaggctggagtgcagtggcatgatcttggctcactgcaacctctgcctcccaggttcaagcaattctcatggctcaacctgtagctgggattacaccatgcccagctgatttttttgtatttttagtagagacggggtttcaccatgttggtcaggttggtctcgaactcctgacctcaagtgatctgcccgccttggcctcccaaagtgctgggattacaggcatgagccaccgcgcccggccagggtgatgtgcttttgttttgtgtattatagattgagaaaatggaagaactacacttcagaggcacgtggattgcagaggatcatattttaaaagaaaacttttgttgtgtttccacccattggctaggtctaaagttttacattttttgcgtagttgtttgcaaatatatatacatttttgagatgaagtctcactctgtcactcaggcaggagtgcagtggcagatctcggctcactgcagtctccacctcctgggctcaagtgatcttcccacttcagccgcctgaggagctgggactacagacacacgtcaccatgcctgtctaatttttgagtgcaaatataatttttaaatattactgggttattttaaatttacattgtagcagttgaaaatggctatgatttgttcagatgcatcattgtggaaaattacatgcagataaaaaaaatcagatttttgcagtacagaattttttttaacatcctacccttcaccctcacacatggattttggactgtttttctaccatgagtactgcttattcatttctttgactttttttaattttaagaaatgtttgtttctagccgggcattgtagctcaagcctgtaatcccagcactttgggaggctgaggcgggcagctcacttgaggtcaagagttcaagaccagcctggggaacatggtgaaacctcgtctctgttaaaaatacaaaacttaggtgggtgggcatggtggcgcacacctgtagtcccagctactctggaggctgaggcacgagaatcgcttgaaccccggaggcagaggctacagtgagccgagactgtgccactgcactccagcctgggtgacagagtgagaccctgtctcaaaaaaaaaaaaaaaagtttaaatttataccccaacaaaatgagcattgcaatgttgactgcaaagtgtttctgtagagaagctacatacacagttggaattaatcattccgggatccacaggtgtgtcagaccacagctgtaggattgccttcagtgtcgagtgctgaagaataatgtgtaaacacccatgtatctgggtgattgctgatatattggggatgagttttaagggatttctgccagctgtaagacccttcattcatccattcatgtatttgttgattttcagtgggatagcatgttatgatacgtgaattatgagacaggacctgaaatgaactatttccatttcttcatttcaccaataagaaaatcaagactgaggaagattaaatgactttcccaaggatgcttagaaacaagactaggatccgagtctcttgagttcctcatccagcatccagtctcttttctcatgatggataaggtgttgcagttgtatctatttggggaaatttctggcatgtcccatctccttcatttggtagcaatagctgttctagctttttgttgctgatcagtagttcctgggattttaagagctagaagggacctttagagactgttttgttcaactccctaaatttataggctgaacttatgatgataggtactttctctgtgtcagactctgggctggcactggggaccgaaaggtgattaggatagtgtccttttcccagggttctgctggttcggtggcaaatgcagatgctttgcctctgagtgaaagtgccaagtgccatgatagaggagtacacagagtgtttttagaacgcagaagaggaatgaattactctccttagtgagttgtggcaagtttgaaaaaatagatcaactttgagctgcactttgagggatgagtaagaatttgtttagcggaaaaggaggcctatgctgatggaaaaacagagctgttaaaacacaaagtatattcagagaacaacagattgtctgatatgacttgaatgtaggatgcagggcagtgagatgctcttgaaatgaggccaaaaaaaaattttttaaggcttagcctgaactgatctttgaaagtccttgtatgtgacattaaatagcatggtctctatgtggaatttatgtggggaagggatgtggtgaagtgtgtgttttaagaagaggtagtataatggccaaggttggggaatggattaaaaaggccagaggctggggctgggtggcccattaggtggctgctgttgtggtctggggcgactctgtagaataagacgagagggcagctgagggcagaaccttccagaacaccactcttcatgggaggcagaggaagaggggctgttgagagaggtaaagaatggttggtgggttcaggcccgaaaaataacagtagtaacaatagcagtcattcattgaatactcaccacacaccagctactccactaagtgcttaatgaaatggacatgccttggcccctggcagccctgcatggctgtaggcttatcctctattgtacagatgggaagttgaatagtttcatggaagccagagaaaagaaagtttccagaaagaagggatgggcagcagtggggcaggtcctggtgaggtgagatgtggttctagagtccctgggatttggcaggtgaccctggctctgtttttcccaataggtattctcagcctctgcacgaggagatagccctgcacaagtaccttaagcaccgcaatatcgttcagtacctgggctctgtttcagagaacggctacattaagatatttatggagcaggtgcctggaggtgagtagtcgctgtcttctggtctcacattctgaaaatcactacgacgtggatgtcatttgttgtcctgccatttacaaaatgacagacccctaagccaggcctgtagggcgcctgtagtcccagttacttgggaggccgagatgggaagatcacttgagcccatgaggtcaaggctgcagtgagccatgatcacagcactgcactccagcctgggcgacagagcaaaacccatcactctttttaaaaaaaaaaaaaaaaaaaaaaaaaaaaaaaaaaaaaaaaaaaaaagcaacagaccctttagatgttggaaagttggatactttccaaatgtcatataagcagtctatttctggtttgttgatgcagtttgttcaacccacaaatattcattgactgtctatggagaaaacatagtctttggccttgaggccttcacagtctaggagtttaaaggtgggtttggacaagggtgcagaagagggaacatagatgttaaaagtgacagtgcaaaatagcattttgataatgaaatcaagcatcagtgttttatccacaaaaatccctgaatgcaagagatagggcacaggaggggagttcctgggatctggacccagaccatctagtctgagtccgttcctccatccacaagctgtgtgacttcaggcaaattgttatacctctctgtgccctcagttttctgattgaataaatgaactgtaaaattggagtaataatgactctgataattggagtaataattattggagtaacaattaacgctgtctcagtgggctgttgggtggattctgtctggcagagaacaagagctcagtaagtgctcattgaaataatgaatcaaactctttaattaaataatagttatctgaatacagatgttaaaacttcagttagaaatcttcattcattcattcaactgacagttattaagagtctgctattacaggaagagtcttaagtatatttattaagagccaggcagtcagccaggcacagtggtcacgcctgtaatcccagcactttgggaggccaaggcaggtggatcacttgaggccaggaattcgagaccagcctggccaacatggagaaaccccctctctactaaaaatacaaaaaattagccaggtgtggtggcgtgcgcctgtagtcccagctactccggaggctgaggcacaagaatcgcttaaaaccaggaggaggaggttgcagtgagccaagatcataccactccactccattctaggttacacagtgagactccgtcttcaaaaaaaaaaaaaaaaaaaaaaaaaaaaagagccaggcagtgggctagattttcagggttatgttagaataaataaagtagtttgtctttcccttaagttggtcatagtctatcagaaaactcgtccattgctgctttttctttttttttttgagatggagtctctctgtctgttgcccaggctggagtgcagtggtacgatattggctcactgatggcaacctctgcctcctgggttcaagcaattctctctgcctcagcctctcaagtagctaggattacaagtgcgtgccaccacgcctggctaatttttgtatttttagtagagatggggttttgccacgttgaccaggctggtcttgaactcctgacctcaggtgatctgcccgcctcggcctcccaaagtgctgggattacaggcgtgagccaccgtgcccggccccttactcttcacgttagttgataaccccatccccggcgttaggtttaagggtatcaacagaaatagagacagatgtgttcatccccttttatagatggggaaaccaaggtagatcaaggtcccataacactgtgtaagtgggaatctgagaccagccgatgtctgagggcccgttcctgccaatggacaggacatcccgcagttcacatgatgtccttcgagacgtggtcacagtgtccttaagggagcttttcttttggcccaaatgttcagtgtttaatagcgtaattgggggaagtggttgttgatcaagacagtcctgccctgagacttgccactgtggctttctcacattgaggacagagagacccaacttcctccagtcctagtccttgtcaccctaaagggcccctcactgtggacctgtccacctctgattacagacaaggtataaaacgtggctttaacccaagcagaatgactgagacagacctgctgtaaacaagtgtcatgggacctgagttatctacgccagcaggccatgcccctcaagttgagagagcattatttcgctctcctcctaacttcatgtagctgaacagagctaaacccacaattggccccactgaatttcagggggcacaaggggttcatgttcaccctgtgcctctggttaggttcatgtgctcaattgcttccagtccattccctggctgtagctacagaggggaggaaacatgttgcatttagcccagatccgatggtgttggtgtaagcacttaggttaggttagaaacctcacctcactttatttccctgaacttttattgaaactttctcttcctgataagttttttgctgtgactgtctctaggaagcctttctgctcttctgcgatccaaatgggggccgatgaaggaaccgacaatcaagttttacaccaaacagatcctggagggccttaagtatcttcatgaaaaccagatcgtgcacagagacataaaggtacttgcttttttaagctgacgaggttgcctttgctcgtatcagatcatgagagctgtcgatggtgtctgctgagtgactggctgacagaggggtatgatttagcacaaccgtccccaaaatgcaaagtctagttttcctagagacttgtgacggtttcccaaggtccagatctgtttcatatgagttcgtttcagcctgtcttttaagcacttgatgatgttattttccgaagggcgataatgttctggtgaacacctacagcggagtggtgaaaatctccgattttggaacctcgaaacgtcttgcgggtgtgaacccctgcacagagacttttactggtaagtggaccaaagcttggcacagggtgcccatcccagagttacgctttctgcacaagctgcggttgttcagccgttacttagtgagcaccttttctgagcagagtgagcaattgatacttgaagtagacagtggattgtccccaacttcaaattgttttaactttgtcatagtgatgcacctagccagctacttgtggcaacaagattgccctactttcttctttgtcatccaaaagttgggtagatggagtgctctgctgaggttctgaggttttcttttcttttttttctttttttctttcttttttttttttttttttttttgagacggggtctcactctgtcgcctaggctggagtgcagtggcacgatctcggctcactgctacctccacctcctgggttcaaatgattctcgtctctcagcctcccaagtagcttggattataggcgcgccccctaccacacctaattttctattttcagtagagacgaggtttcaccatgttgaccaggctggtctcgaactcctgacctcaagtgattcgcccacctcagcctcccaaagtgctgggatagattacagatgtgagccaccgcgcctggcctctgctgaggctttctgaaggtcactcaaccaatcagcaagatggcagcacatctctttaaagttaatagcacattatctgaaatcgtgggtaatgctgaataacagtattcctcagacaactgattaagacattttattggtctgtcataaaaatagcctgttactgtagtgaattctggtaccttgtgttttgatatgattgtgtttccaagagaggctaattcttcctggggaatatggtattctaagtgattttgaggaattggattttcttgtccatgtgtcagtaatggaataacttgagcattgagagggactgggttcaaagggtggtatacaattaccagctagtttcacagttgtaagatcaataagtagaatgatggtcaaaagctacttgtggctattggaaattcctgcttaaacctgactaataacaagaactttgatccttggaaagaagtactgatttttgaataagtaaaggtttatagtcccccaaggagtaacgtaaagatcacaaagatcttgcttgatggaattatgaaacagctggggcctggtatagtggctgacacctgtaatcccagcactttaaaaggccaagatgggaggatcacttgaggccagcagtgcaagaccagcgtggtcaacatagtgagaccccatttcttaaaagaaaaaaaaaaaaacagctttcataggctgggcactttgggagattgaggcaggaggatctcacttgagctcaggagttcaagaccagcctgcgcaacatagggagaaccccatctctacaaaaaataaataattattattattacatattatatttatatattatatgttatatataatataatacataatgattatatataatatatgtatataacatatattatatagtaattattagctgggtgtggtggtgtgcgcctatggtcccagctactagtgaggctgaggtgggaggatcgcttgagcccaggaggttgaggctgcagtgagctgtgattgtgccactgcactccagcctgggtggcagagtgagactctgtctcaaaaaaaaaaaaaaaaaaaaaagaaaaaattagctcttaaaataatatagctctgaaataagctataaaagacaggtgactgttctctatctctgcagtcaccaaagctgtagggtggacagcttgggtcttatttttggtaaataatgtgtcagctttgaaagactttttgtcaatgagagagttgtcgcgtgtcagccactggacacccacagtggagacacattcaccatctaaagagaattttaatacatcacaaaatgacttctcacttgtaacacaaggggaggtacatgtgcctgaaaatgggaaaatactataccagggacactatcagaatctcccaaagaaagagtgcattgaattttcattcattgtttctggtataaatatacgtatacatctgtcaatgtgtgtatatgaatatgtgtgtatgactagcacttcattttcttttagcattttactaccctaattgaaaatgacttgtatcctcctctttggaagccaccaattagcttggcaatacatagcaagaggggctctgatatgacaaggagttatttgaagacataaaacccccaacaatttatctcataattagcttccctgaggaggaaacaaactcacaaagaaacacatgtataattcatccttgcatatcacacttcccaagtaattggcttggggaggcacggattttgcattgcaaaagaatgcaggggtgtttgggggataataaggaaggggtctcattttggttaggaaattcccccgcatataattgctctttgcaaaacagagcagttctgtaaggaaatctcagctggttggtgcagaactctgggtctgtggttgctcagcctggcaggagagccagagggtttcagtcaacttcctggcctggagccctccctccctgtgttcctctgaagggtttgccccacacataggaacctgcgagaacaggaggaagggctgttatagccagggtcagccctgccttttttttttttttttttttagcagccttatcgaggtatagctgacatatcatcaaagcacccattagaagtactcaattctttggttttcagtaaatttactgagttgctcagccatcaccacgatccagtgtctggacctagcagaccccgtgccccttggtactcatccccattcccactccagccccagctcatcactcatctgctttgttgtgtttgtgtggctttgcccgttgtggatattcatatgcttggaatgaatacaatatgtggggttttgcatgtagcttcttgcacgttgagtcctgtttttgcagttcctccatgcagtggtgtgtatgggtacttcgttgttgttcatggctgaatggcattccattgtgtggagaaccacattttgttcatccgtttaccagttaacagtcatttgggattgtttctactttttggccactgcgaataatgatgctgtgaacattcacatacaaagcgtgtgtgaacatgtgttttcagccttcttgggtagatacctagagggagaactcgggacaggaagtctgttctcgtctggctgcaaacatcgttggttcaaatcctggcccaaccacttgctagctgtgtgaccttgggcatattacttaacctccatgtgcctcagtttcttcgtaagtaaaatagaaatgctcgttgtacctactcatagggtttttatgagggtaaagtgagttactgatgaagtgctttgactggtccctggcacatagcaagtgcaattgaagtgtttgctaattaaatactcgcttgtacttagaagtcatgggttattagagctggaaggagcctttgagagaactgagtttgtgtgtgtaactaacgtgttgaacccattggactcaaagggtgtaatcacaaaagccactggatttttctctcccacttttcatcctgcctggggcgggagttctttcctttgacttttccagccacccttacataacagagaaagtcataatgacacttgaaggagcgcacacagtctgaattcaggaattaaaaaggactcatcgcttgaagccgggaggcggaggttgcatgagccgattgtgccactgcactccagcctgggtgacagagcaagaccctgtctcaaaaaaaaagattcaggctgatactgatcaacgctctggtcctcattcaaaagtcagacccctctcccgtctccctgcaggcagcgacctgtggtcaggagctgggtgttgtctttttctccctaatcaccagctgcaggaaggagaggacaggggcagggaaagttgttacttgactagcactgttggaagctggctttgcgtgctgtgggcctggctgatgtttagttatcttccctcgctggctccctctggatgtaactcctgtgtcgtgggcaggggcctgtcctttggctgacagccccctcctcccagttatttaccccttacatcacctcctccttccatctctttctgttgagggattcagatcgtggaggactgcgtttgagcaggaattccttttcttttttctttatttttttattgggcagcccctggaaccagaataggttctgagagagactcccaggattccttttaagaagaccatatgctgggcacgcctgtaatcccagctctctgggaggctgaggtgggaggatcgcttgagcccaggagtttgagaccagcctggccaacatagtgaggccccgtctttaccaaaaatataaaaatcagctgggtgtggtggtgcgcacttgtagtctcagctactcgggaggctgaggtgagagaatcacttgagcccaggagaatgaggctgcagtgagtcataattgtgccactgcactccagcctgggcgacagaatgagaccctgtcaatcagtcaatcaatcaaataaataatacaaataaaagataaaccctaaggcagtatttctgtaatagggtcccccatctggtgtccagagttcaagcagcttcagcccactgttgagagggtgtggcagtatccccacaccttacagccccctgtctgctgctggaagttaacctttgctcacttgggtgccagtccactgtgtaatttacctacaggaacacatacacatggagctgagtcgctcagtgaagcccccttcaaaggctttgggttaggaacaagtggcgccacctttccaccaggcttatcccttggtcaggtcaactagggtagtcccctggactatgggaaaatcgtaccttacttttcttttctgtacttgattaatatgaaatcttgaaatttaggctctaacggtatctccaagggcctgtggaagatgtgatgatcataagttggtattgagtggcttgagttgccctgggcccacgcccttttggggacagtcctgccccaaatcctgtaacttgggagagggtaggcagcccagcatagctctctctaaagaagctgtctcagcaccacccccctaaactactctgtcaactctctcagccccttgatcagattagaaggtccctgggcctcggttataaacttgtgtcttctgctgtgtgtcttctttgctggtaatctgaaaatcctattggacaattctccaggagtccccagtggattttgtgccctaggggggctgagtcagtgcctgtgggtctcttggtcaccttgttctgaactctgcaccactgcactggtgtaggtacctaagagccgtagtgggctgtgaccagtgaccagtgtggtagggcataccttggaggaaatataggttagggagcatatggggccccaagagagccagatttttgtttgtttgtttgttttgttgaaatggagtcttactctgtcgcccaggctggagtgcagtggcgcgttcatggctcagtacaacctccaccacccgggttcaaacgattctcctgcctcagcctcccaagtagctgggaccacaggcacacgccaccatgcccggctaatttttgtatttttagtagagacggggtttcaccatgttggccaggctggtcttgaactcctgacctcaagccatccacctgcttcggcctcccaaagtgctgagattcaggtgtgagccaccgtgcctggcctatgagagccagattgaaggaaacccaattttccaggatttgtgcgtgattcagatgccccacaatgccatcttcacttggttttcttgacagaatccagcctttgggttagctgatgtacacacccaacatgcatcctgccagggagtgttcccttgagtatctgaaatagttgtgtgcatttatctctctctgttagctgttctgagagtggatggttaccttgtgaatacagtagtgaataaaatggagcacccagttttccattagtgccctgtaccttccagttacatggaaagatgctccaatatggctttggaaatccttacacgtgctactcttattcaggcagctttttttttccagcagcgcttcttcttgatgtagtgtatggatgagtgatgtcatggtgtgtagttctgaacttgaaggtagaagatatgggttctagcctaagcgaatcctttagcctctctgaacctcagttgcctcctgtgtaaagtaggaataatggtagatagtgcttcctctgcctaaccttccagagtcgtttgagtcagatggacaaggctatgtggagacaattggtaagccatcaagtgctcaccaggagtcagatttgtggcaggcagcctccaaaatgacccccaatgatccctacctcctgatagtcacacccttgcgtagttccctcccgttgaatgtggactggacttagcaacttgcttctgatgaataggaagaagtgggagtgatggtgtgtgacctggacactaggtcataaaaggcagtgtgccattcctctttctctcggatcagtctctctgagggaagccatgtctcaaaccagtcctatggaggatcccatgtaatgaaaaactgaagccccccactagctctatccttagtgagcttggaaactgatcctccagccccagtccagccttcagatgactgtagccccagctgacatctggactgcaacttcctgggagaccctgagccaggtccacccagctagttagttgctgctggatttcaacccttagaaacgctgtaagacctaactatttgttgtttgagttgatagatttgggggatcatttcttaaacagcagtaaataactaatatgaatgtcattattaaatccttgcctttagaaagagtgctgttcaccatggctccatatttttaaaaatctgcaaatttatttttaacttttgtgggtatatagcaggtatatatatttatggggtatatagactattttgatacaggcacacaatgtgtaataatcacatcagggtaaataaggtatttattacctcaggcatttatcctttgtgttacaaacaatccagttatgctcttttcagttttttaaaatgtacagtttttttttttttttttttttttttttttttcccctgagacaaggtctcactcccatctgcccaggctggagggcagtggcgtgatctcagttcactgcagccccaacttcatgggctcaggtgatcctcccacctcagccttccaagtagctgagactacatgtgcacaccaccaaccctgactaattttttgtacttttttagtagagatggggtttcgctgtgttgcccaggctggtctcaaactcctgggctcaagtgatccacccacctcggcctcccaaagtgctgggattgcaggcatgagccaccatgcccagccaaaatgtattgactatggtcaccctgttgtgctatcaaatactagatcttattcattctttctatttttttttgtacccactaaccatccccaccttcccccagtccccactgcccttcccagcctctggtaaccatccttctactctccatgtccctgagttcaattgttttgatttttagctctcacaaataagtgagagcatgcaatgtttctctttctatgcctgacttatttcgctttatataatgatctccagttccatccatgttgttgcagatgacaggatctcattcttttaatggctgaatggtactccattgtgtatatgtaccacattttctttatccattcatctgttgatggacacttaggttgcctccaaatcttggctattgtgaactgtgcttcaacaaacatgcgggtgcagatatctctttgatatactgatttcctttcttttgggtatatacctaggaatggggttgccggatcctatgataactctatttttaggtttttgaggaacctccaaactgttctccatagtggttgtactaatttacactcccaccaacagtgtatgagggttcccttttctccacatcctcgcccgcatttgttattgcctgtcttttggatatcagccattttaactgcagtgagatgctatctcactgtggttttgatttgcatttttctgatgattagggatgttgagcaccctttcatatgcctgttggccatttacaaatgtcttcttttgagaaatgtctattcagatgttttgcccatttttaaaaatctaattattagatgttttcttatagagttgtgtgagctccttatatattctggtgactaatctcctggcagaggggtattttgcaaatattttctcccattctgtgggttgtctcttcactttgctgactgttgcctttgctgtgcaaaatctccaaatttagaattaagcagactaaataggcttcaattaggaaataattgtaccaggatggacagttatttgaccagagccaattagccattgatgtttggtttagcgtttcttttctactgctggatacatctataaatgtattctcttgctctttgaagaaataaatttagtgattatattagtcagggtccaggcagaaaaacaaaaataaccccagttatttccatggagagaatttaatagaaataactgtttgctggttaccaaaaaccagaaaggcagaaagggaggccctgaggtatcaggaagcctgtacccctggggcttgggggtcaaatgggagggtgagattagaacttgttcggagggagtgtcaccaggctggagcaggtacctctgaggggcaagatgaggctggttctggaagtacggggtgacacacagcgggagactggggccgactgagggtccaacgccaagcttagggccacagcaagcacacagcaggtctccgcttcctcccgcatccttccagggtctctctttagcgccacctggttgcggagcctaatggggagctgcaggcgaagcagagtcccagactcagcatcacagagcagagctgagagagggtagcttcataagcagcacagtatcggatccttcctcaattagggattcgttagaaggcacattccctgccaagacctctccctctgttacagcagcaagagcccataggggatattgtgtcatcggatgttcccttcttggggctctgggatttcctaacagggcatcaagtgtaatgcgctgccatgttgcccaactctgcaactcactgaacatttccccgccagggcatcagctctggagaccaaagccatcatttgttcctcatcgatctgttgtgctcactgatacaacccaattcatatttaagtttatatttaagtcacttgtaattgaatacaattaaaacttaaaaatgcatttcttcagtctcactagctacatttcaagggcccaacagtcaaatatatgaggctagtgactaccatatttaaccacacaggatagaacgttgccatcagcgcaggacattccatccgtcacagctgcccctagagtatttaaagaatgctaataagacataggatcttccagagggggacacaggaggtagtttctccaaactttctttatagccagtgcgccctttgctttcctttttttttttttttttttttttggagactgagtctcgctctgtcgccaaggctggagtgcagtaatgcgatctcagctcactgcgagccaggttcaagggattctcctgcctcagcctcccgagtagctgggattacaggcacccaccaccatgtctggctaatttttgcatttttatatttttagtagagacggggtttcgccatgttggccaggctggtctcgaacttctgacctcaggtgatccgcctgcctcggcctcccaaagtgctgggattacaggcgttagccaccatgcccggccctgctttcattgattaaacctttagttgtgtaatcctcagataggcctttgaatttctctgggtttcagtgttctattcatgcgtggccaaggtcagagctctgactttgctgtctttttctaaatttctttgccagcccccaggagctgctgtcactttcacacacgtcccctttgcacaggctgagtttcaaggaaaacgaaggatgttattcgcagagcccttgactgacctccccgtgtgctgtctcccacaagagcacgtccaaagccagagccctgggcccaccctgcttgccactgggcctgtgcccttgccattgcctccttaactattcccacaccctgccccgtgtcagacatcgcttgttccccggaccgctgtctatctcacacccatgatcccctttgtccagccctccagccttcgcagcaggaccctgcttccctgacagccccggctaccaacccagcaaagttacactttacccaggctgctccccaccaaggcctgagcctggcaggggtgctagaacccaggtgggactcctccagtggatgacttggggctgcagactccccagcagcctggctgaagccctctccgggctgctctcccatcccagattcttcctgattctgccttcctctccgctcccaggtgttgcacctgccatgtggtccgcagccggccctgcccaccctgctccctcccgctttgtccttcagagaccttctccccaataaatctctcatatgtctcatctcgtcttggcattttactcctcagaggcccaaatggacacagccatagtgtttcctgacccgaaccaggcagagagtcaaaccctattttattaatgctcttgcagccttctgtgtatttctctgtcctagcacctaccacattttgccattactgccaccgctgccagcattctgtctttgtctcctccactaggcacctccctaccatcaggctgtgtttctcacgttctggcttccctgtatttggcatgtactaatatgtgctgactgaattgcgccatttgtcctttgatgggccaggcagtcctctctccacgtggttagtattaaaggaaggcatgttgcatgcctctgctcaaagaaatatgcagtcaggccaggagcagtggctcacgcctataatcccagcactttgggaagctgaggcaggcacatcacctgaggtcagagagaccagcctggcccacatggtaaaacctcgtctctactaaaaatacaaaaattagccgggcatggtggtgtgtgcctctaatcccaactacttgggtggctatggcgtgagaatcgcttgaacccgggaggcggagttcgcggtgagccgagatcacgccactgcactccagcctgggcgacagagcaagactctgtctcaaaaaaaaaaaagaagcaaccatattatttatgcatgggacaagactccatctgccatttgtgaagccattcatttcacagttagtggtgggttttttgttttgttttgtttttgagacaaggtcttgttacattgtccaggctggtctccaacacctgggctcaggtgatcctcctgcctcagcctcccgagtagctgggactacaggccacttagtttctgagcaatatggtacccacagcctgtttgtttgttttccaaataggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtaagtcatgcttcgtgattgaggttgggcgtggttgggaagtagaattaaaaacaaagtctcctcccaatccagaaaacctctccacaaaggtaggagagaaggaaacagttttattattggataagcattaaaccagaatgcgaggtgcatcacaggcaatccactgagactgcaaagatggaaagcaatctcactgtttcatagagccgagcagacacaacccgtgacatctgtgttctcaagagaaaccgtaactagtcctcaagtaagacaacttggtggtgccatttgtcacaaggagctcatcttagattcacctggtgattggggggaccattggtgttcactgtttggcttcatccaaaggaaaatataggccgggcgcggtggctcacgcctgtaatcccagcaatttgggaggccgagatgggtggatcacctgaggtcaggagttagacaccatcctgggcaacatggcaaaacctcgtctctgatacaaaaatcagctggacgtggtggcgcatgcctgtaatcccagctactcgggagactgaaacaggagaatcgcttgaatccaggaggcagaggttgcagtgagccgagattgcaccactgcagtcccgcctgggtgacagcaagacactacctcaaaaaaaaaaaaaaaaaaaaaaaaaaggaaaaacactaaacttctcatatctttaagacagtaggtagttttggagtgaagccaccatcaaagttagaaacctaccttcctatttctgggagagcagagttatgaaaacattaataaaagatgacaggtttaaaaaaaaaaaagaaaaaggaaactaggagatagaggccctatcttctttgatgattacatttcagagagatggcttccaggtccttgcaaaagacatttctggcaagagtcttatttagccgtttaaaagattcacgtatatctcagagacagagaaagaaccttaaagttataagttctctcaagtcaaggctctaagaaagctgggcagggtgggggagggtcctttccctttattttcaacagggagaatccagccccttagtttcccttcatgtttgctcttacagtgggtaaggctcaaaggccatgtgggatctgtgcctttgggggacaggtttctgactggcttctggagaggtgggagttgggctatcaggtaaatatatcccttatcattccaacaaccctccccgagctaacaggaagggcagcccatgtactggggccaacatagtgcagattgagcattgcgggtgggggttttaccgccgagcagccaagattgtggaaagggatgtccttccttgtgacctcacgggaagctgatgccaggacaccccggtgtacccaaggttgggtgtgcagcttctggcctcatgtatgcttagaaacatgtaaggggcttgatgtggtttggccatgtccccacccaaatctcatcttgaattgtagttcccataatccccacgtgttgtgggagggacccggtggggataattgaatcatgggggtgatttcccccatccagttcttctgatagtgagttctcacgagatctgatggttttataaggggcttccgcctttgctggttctcattctctctcctgccgccctgtgaagaggtgccttctgccatggatgtaaatgtcctgaggcctccccagccgcgtggaactgtgaatcaattaaacctctttataaattacccagtctcaggtatttcttcatagcagcatgagaacagactaatgcagagctctagccctaggatgccattaccagcactgaccttccatggggcactgccttgagacagcagggtcacaaaaggccaaatggccattgcttatggatgatgaggccgcagtgtgtggacacggccctgatagaacgcgattccagaggcgtcttcctggcttctctgccaaacacggtgccttcatggcctgtgtctgtgccaggctctctgcttccctcttgggcagaaggaacttggaggtgtgagtgcaggtttctgccggttgaggtgagggcagcatgttcaatgggtcccgagtgctgcctgcttgggtgccttggctgctctctccagcccggcgaggcccctgcagaagggtctcagagcttctcacctcctatcagctgcttgggttcagagcccaggccaagacctcaagtcgacaagagtcttctgatacctgcaatcccaagaggaccctcagctcctgggctggaagacagcaatgaccgtcctcagcactttgaccgtgtgcggtggaccctgttggggccgttgtagatctaacctgcagcttccatggcagcgttggaataaacagcagctggtgacgaggaaaacatgaggcccacctgagagccatggctggctgctttttgacctgctgctgacttccgggaaaccagggagagagctgaaggctgtgactggctcgattcctccgcagggcatgcctggctccccgcctcctcttgtttttgtttagcgaattcactgtacaaagtctctctttttttttttgacagagtctcactctgtcgcccagactggagtacagtggcacaatcttggctcactgcagcctctgcctcccgggttcaagcgattctcctgcctcagcctcccaagtagctgggattgtaggcatgggccaccatgcctggctattttgtatttttagtagagatggggtttcaccatgttggccagactggtctcaaactccagtgatccacctgcctccgcgtcccaaagtgctgggataacaggcgagagccaccgtgccccgcctgtatgaagggtttgaaaatgtactgacttttttggatggcatatgaagtcacttttcattgccaatgagaaagttattattaaataagtaatggcccctgtgttatttctgggatccttcattcctttagaaaactttcaagaaacttctgggcagtgtctgaaacaaaggacactctctttcccctgaagggactgttacagatttaactgtgtcacccaaaaatgatatatggaagtcctaacccccagtacctcagaatgtgaccttctttggaaatagggtctttacaaagaaaatcaaatgaaaatgggttctggaatgtgggccctaatccagtatgactggtgttttggactttttttttttcttttttaaatctttctttttattttttttaactagtcaagtgaaacagtgggagtggggaaggaacaaagaaatctctaactggttgtcatcaactagctgcaaacaccactgcactcggaccagcctggtgtcttttaaaaaggggggatatttgagccaggtgcattggctcacccctataatcccagcactttgggaggccgacgcaggaggatcacttgaggccaggagttcaagatcccccggggcaacatagcaagaccccgtgtctacaaaagatgaaaaaattagcccatgtggtggtgcacacctgtggtcccagctactcaggaacctgaagcaggaggatcccttgggcccaggagttggaggctgcagtgagctatgatcatgctactgtattccagcctgggtgaccaagtgagaccctgtctcaaaaagttggggggtgggggtggagatttggacacacatgctcagaagacaaagtacgattcccaggggaatgcctcggggaggcagaggagagaggggggtgcatctaggagccaaggagcgccagagaccgcccgcagaccacgagaagctagaagaggcaaaggcggggattccctgcatgtttcaggagtccctggccctaccaacgcttggatcttggacttccagcctccaggactgtgagacaataagcacctgttgtttcagccacccagtttgtggtattttgttacagtggccctaggagaccaatacaaggagcttttgggtcacggcaaagcacccttaaagaggacatcccagccgggtgtcattgtgctgcccacatttgctgttttcagagagccgggcagaggccaccctttccttttcatgttcttgcctgaatgttggtctttgtacccctagtgcctgtgaacagtgccagcttaacctccctaccgctcaggtgagaggagccacctgtgaggcaccctgcattgcagacctggcggtgggtgggatttcacccagcatttagtgttcttcgaatccgtaactcctgagctgggcagcctggccaggaggagcgctgtgttggaaacagcacatggccgtgactgccaggtcaagggccttggggacaggaagtggggaggcctggccctctacactctgcagcaccctgagctcactcggcggggattgtggaggctgagccagcccccaggagctctgaggagctgggaatgggcatgggtctggaggacagaacagcttccacgcctggattgttgggtgggcttggaaaagacacagggtggactgtgaaactgaaggtgacaactcctaaaaagatgagagggccaccctactgggaacagttatgaaggagggggctatataacatgtcacggaagcatgtccgtgtcacagcgagatgtggcagctcagaaccaactcttacttccctacaggtcacagggacagagagccattagttacctgtctatacattggcagcctcaaggttttgtctgcttgtggttttgagctggaggctgggaatctgggctgtggatgcagagggattgagaggtgttaaaggcatctcttggggaccctgtgcgtcagggaacaggtaacagatgcctttgagtatccttagaggacatgccgccctaggctgtggcccaagtcccatctcagttctctactgctatgtaccaaaccaccccaaaatttcagaagcttaaaacgatgactttttctcatgcctctttgagctgactgttggctcttctgtgggttttgcctgggctcactcacatggttgcagccaagtggtggtttgggggagcagggtggcctgagaggcccctccctcatggcagttccagctgggatggctggggcgtcctctccacggggtcgtacctcctgggcttcctctctgcatggtggtctcggggctttaagggtgactagcggagccacaagacctcttaaggcccgggccctgaaactctcaccatgtcacttctgtcactatctgttggtcaaagtcaagtcacaagatgccagtgagggggaaatggactccaccttggggtgggaggaacaagaacgtgacgttgcaagggggcatggattatgcctgtcctgggatgtcaggtgtacaggagctttggactgagacatggatacctgaattcacccaaggcctcactgacacatcggttacctctcccttaaatgcaggtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcaggtgaggcctccctggacagctggggcagcaccctggccacaagaatgctgggcgctgggcttctctgctgctcaggagggagagttctggctatccagagccctgggctgctcacgtcattcccatttttgtgaagagtgacggggcctgtgcagtaggtttggaggttgtcaaaatccaactaatacatgcacctcgatctcctgacagaggcccagggagtctctgggtgactgggctgccgtctgctggaagttgttccttcgggattgggaagagagtggggaggcaagaggtaccccagctggggttctgcgtcttcaccatgtgccagagcctggggcttcagttttggagcctggcttgtcatcgtgtgccaaccctgaccttgattaaaggatttgtcagggaggtttgcctgatgtggctgtcctgcaggccaccgaagtccagtgacaccttctggggcagtaagtcctaactggcaatgatgtaagagtggcccctgaaaaggaagcagtttgtcctcttttccctggtaccgatcggggtcagaagctgccagagtgagtggctcagcaacttgctccatgagggacccccaactgcatgcatctgagtagaaatacagcacctgtggcccgtcccccgcccaacccacatttctacaggatcctgggtgcctgggcggttcacctgggcttgaggggctgccagggactcagctccaccccgtccctctctgagtctccccattcggtgtctggctgtccccctacagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcaggtacacccgtattctgtctgtctgccgcgggcccgaaagggtgctggtagtcctccgccacagggcacctccctggtcccaaccagatggccactgaggggttttacttcccttctgcagggcagtagggcagctgagccgccccatcccggcaaggagggtgcttcgttcacttgctgtcccttcccctccctccctgtcctttcattccccacatgtgccctcccccacctctcctcttcccttctctctcccctctccttcgacacttcccctctctcctcttccccctctctctccccctcacccttgccccctctgtccctgcatcttccggccccctcctcctcctggcccctcctcctcccttcctccttttccttcctctctcttcctccttcccctgtccccctcaccttccctccctcacctctccttctgtgcttgcccccttccctccctccctccctcctccctgtctcctgggaggctcctttaccccgcctccccctccttctgctctccctcctgctgtgggggttgacagaacactgcatgtctgtccttcctccggcaatttcatcttcttgagcacagggactgcatcgcagttacctctcagcccttctccagggcgtcctaacatgacacactcccagggacagtgccccggcacgcacagagattgtcacacgtgtttgtccacagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccaggtatttgcccgagggagggcaccgactcttcccgctccctctgcccaggtcccagtccccagacaggtccaatcaggacctcagttcctgccgccctggaacatctgcatagttacggtgatcactgtaaatgtttccctaacgtccttcccttccccaacaaaacaaaagaaaatacaaagaaaaaaagctctgccgaaacatgaatttgcagataccgcagtgattccaggcactggtggggcggtgctgccccctggtgaaaaccagccagattgtagcagaaagcccgaagcaccttctctggcctctcatgatccggttttgagtcctggagttaatccccagctgtaggacacgctagagctgccctcagaagctgggagaacagccaccttggggagggtggttatgggtgaaaataactgattttgaactagggcacaggactggcaaaccgattcccctccattatttcagtttatttattattgttttttaatcttttttttttttttttttagacagtctcactctgtcgcccaggctggagtgcagcggtgtgatcttggctcactgcaacctccgcctcctaggttcaagtgattctcccgcctcagcctttccagtagctgggattacacagcgcctgccaccacacccagctaatttctgtatttttagtagagatggggtttcgccttgttggccaggctggtcttgaactcctgacctcaggtgatctgcctgcctaggcttcccaaagtgctgggattacaggtgtgagccaccgtgcccggcccccctcccttatttcagatggaaaagggccttttaggaagaggccgctgctccgctctgaactatgtctatggccttgatgggggctcttacaaggggttaaacaggaagccattcacagaggggcttagctgtacacccaccagggagaaggggccaggaccctgacaggaaggttatggagggaacaaacagagaccccttctcacctgggagttccacaagtttcttagcaaatggaccatcttgtttcccccagtgtgttctgaactctcgctctctcaatctgactcaatgaaaatgatttgtgtgtgttttcagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaagtgctccatctggccctagggaacacaccagatcttggaattcagttaccacctcctcccatagcccccatctcttcttaactgtatacacctgaatcccaagcttcagcagctcctcctaaacaatgaagtccaggaaatggcatctgggtgaactggctgattgcatgcggcccccaagaggatgagtgtaggttgccgtgattctccgtgcaatgcactggaaatctggatttttgtgattttagtttattttattattttttttttttttaggtaaataaaattttgaggaaccacttaattaggccccactggatgttcgcgatggacaacatcatccgccgagcggtgcaggccgcggtcaccattctcatcccaggtgagcgccccctttgtggtcaaggtcagctttaggccgtgaaaagataagaaatatcctcttcattcaacagttgttgcttttctcttttccatcttggttatctacttccttggaattaaatgcatgttgtcatagacttcttccggggctgattctgtagttctgagagcatctcgtggtgctgtatttacgtgtccctgaagcatgatgaaggtgactacacataaactataactcacaatctcaaaagggagcatggggccggacgcggtggctcatgcctgtaatcccagcactttgggaggacgaggtgggcagatcagctgaggtcaggagttcaagaccaggctggccaacatagtgaaaccccgtctctactaaaaatacaaaaaattagccaggcttggtggcacgtgcctgtaatcccagctactcgggaggctgaggcaggaaaatcgcttgaacccgggtggtggaggttgcagtgagccgagatcacgccactgcactccagcctgggcaacagagtgagattccgtctcaataaaaataaacaaatacataaataatattaaattaaaagggagcatggggccagaggggaaggatcctccagtcctctggtatccccttcatcgtgcactcaggaatgtttcttgggtaactgacaatacagtggctcagattcctctctctgaatcatcatgtagtagttacagaagtttttggtttttgtcaatttcctttttgaaatgttaccaaagttgattctccttctctggtgacttcttcctgctaagggaggctttacagcccattctgtcgccatcatggtttccccctttccttcagctccttgctgtttggctccagcccaccctcccgaatgcactgtgtagcccaggctcagctgcaggagaggcttgggaaaccccagtgcttaattcctctcccactccaagcagacaccttctgtagtaaaacggcacaggcttgggtggcagcctggctctacttatttctttcttttctttttttttttttctgagacagagtcttgctctgtcacccaggctggagtgcaatgatgcgatctcgcctcactgcaacctccatctcccaggttcaagcaattctcctgcctcagcctccggagtagctggggctacaggtgcgcgccaccacacccagctaattttttttagtagagacggggtttcaccatgttggccaggatggtcttgatctcttgaccttgtgatctgcccgcctcagcctcccaaagtgatgggattacaggcgtgagccactgcgcctggacctggctaatttttgtatatattttttagtagagatggggtttcaccatgttggccgggctggtttcaaactcctgacctcaagtgatctgcctgcctcagcctcccaaagtgcttggattacaggtgtaagccattgctcctggcctggttgtaccttttgaacgctggccttggttcacttcatatccttaagcctcaatttcttcctgtggaaactggcgtgatcaactttacgctgcagagaaccaaatggaacagtctcttctccatttgtaaagtcagcagtcccctaatggagcatggcacgggctgggccagcttctgaacagcccggtttgctgacctgggtgtctgcgaccccaggccccactggcctggtttgctcaccattgtcatgtcttgtgtgatttgcagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacaggtgaggagcttctgggccctcctctgggagcaggcgctgggacagtggcctgagccaccaagatgctgattaattggctttattgttgaccatctcacccaggtcttaggaaaaagcagcttcatcatccacgaactaggcaagggcgcatattctcagcctcaattgagggactagaggaatgccttcctttaaaaaaaaaaaaaaaaaaactcagaatcagagaggtatatatagtaccttgccccagaccacacagaaattactcatactaaaggcagcagcatctgtgaattctttctctcttttcaccaagacggggcccctggcatggtgtgtgggtctcgcaggctcagcagcctgcccctgcagaagtagcagggtttgggggttggttagcacttcatcagtggatgtacatcccataatcccgaccccgaggaagtttgtcctgttgtcatttcttccatgtgatttgtcatgatccctagacgggcattagtggactagcttcccaaccagggaaccctggcatcaccatcatattcctccaatgcactggtctgttttgttcacttcctggcacatagtaggtgcttaatatttgtgaagtggatgggcgtggtggctcacgcctgtaatcccaacactttgagaggccgaggtgagtggatcacttaaggtcaagagtttgagacagcctggccaacatggtgaaaccccatctcttctaaaactacaaaattagccaggtatggtggcgcacgcctgtaatcttagctgcttgggaagctgaggcaggagaatcgattgaatccgggaggtgggggttgcagtgagctgagatcgtgccattgcactctagcctgggcaatgagagaaactccatctgaaaaaaagaaaaaaaggggaagaaatatttgtgaaatgaataaaattattcctgtttgctctgggaagtcacattatcagctgcgtgatttggtttttaaaagtaatccatagttgaccgggcacagtggctcacacctgtaatcccagcactttgggaggccaagatgggtggatcataaggttaggggttcgagaccagcctggccaatatggtgaaaccccgtctctactaaaaatacaaaaattagctgggcgtggtggaacttgcctgtaatcccagctactcaggaggctgaggcagaagaattgcttgaacccgggaggcggaggttgcagtgagccgagatcgtgccactgcactccagcctgggcgacagcatgagactctgtctcaaaaaaaaaaaaaaaaaaaaaaaaaaaaaaaaaaaaaaaaaaatccatagttatagcaaatgagttggtactcattccaaatgacactttgttgctgtgggatcattgctgaggaatgctaatgactatttaaccgggagacaaggggccagttacgtattttggatgaaaggttgtgtatgctgtcagggatctctcaagttcaatcttagatcatctaatcatttctttttttaaaagacccagagctttagttaaatggtagtggtggcaacattttgaaagtttttttttttttttaagttcaagagtacaagtgcaggttttttacacaggtaaacttgtgtcatgggggtttattgtacagattgtttcatcacccaggcattaagcctagtatccattagttgcttttcctgatcctcctcccagcctccaccctctggtaggccccagtgtgtgttgttcccctctatgtgtccatatgttctcatcatttagctcccacggcacgtggtatttggttttttgttcctgcatttgtttgctaaggataatggcctccggctccattcatgtccctgcaaaggacatgatctcgttctttttttatggctgcataatattccatggtgtatatgtaccacattttctttagtctatcatcaatggacatttaggatgattccatgtctttgctattgtgaatagtgctgcaatgaacatatatgtgcatgtatctttataatagaaccatttatattcctctgggcatatacccagtaatgaggttgctgggtcacccaataagatttataatcaccaaattcataaaatgattatatatgggtttgaaggttatttctctccactgtcgatagtcattgtgttattttccagtctcagtggaatgaggaattggttaggcagcagccagtctgtgaatggcattgacgtaaactgtacattcctgcataaggtgcttgtccttgtgtgtattagtccattttcacgctgctgatacataccagaaactgggcaatttataagagtaagaggtttaatggacttacagttccacgaggctggggaggcctcacaatcatggcagaaggtaaaaggcacgtcttacatggcagcagacaagaaagaatgaaagaaccaggcggaaggggttttcccttataaagccatcagatctcatgagacttattcagtaccatgagaacagtatgggggaaaccacccccatgattcaattatctcccactgggtccctcccacaacacaagggaattatgggagctacagttcaagatgagatttgggtggggacacagccaaaccatatcactgtagtatgaagtgccttggctatgtggcagttgggcagagccaaaggaagatgacacctcttagacaggatgatgtgtctgtcctgatgaagtcctgagagtccttcccactggatacaggcacaagcttgagttgtctccttcactaacgtaaaaggaggactactagagagaccaggatgaaggcaggcagttgggcagggctgggagaggacttctaatttgctgagtgccaatatttcctctgctgttgtgctggggcagaagtgttctcctctccccaccccactttgccaccaaataatccaggagttcctgtgttctcatctctctactgttgcagtgacttctcatggcaacttcaataattaccttcagtctttttttttttttttttttttttttgagatggaggctcgctctatcatccaggctggagtgcagtggcacattcttggctcactgcaaccttcacctcccgggttcaagcgattctcctgcctcagcctcccgagtacctgggaccacaggtgcacaccaccacacccagctaatttttgtatttttagtagagatggggtttcaccatattggccaggccggtctcaaactcctgacctcaggtgatccacctgccttggcctcccaaagttctgggatgacaggtgtgagccaccacccccagcagccttcagtaatttcaataaagcttagttctgtattcccaagttcaccagcatggatcatataaatgaattaaaggaacacacagttaagaaacaaatcccatgtactaggtatgtaagcaaacaataaaagtgtgggggccaaggcccttggcccctggaggtttgctgaaaatcacctgcatgaggctgattaatgagagaaaaggcatgcaaatgtatttaacatgtatttaacttcagcatgaagacccaaagatccaggggaaattgtccatttttatgcttaggcttaacaaagtatggagagctgtggagaaacagggataaaaagggcctgatcgaatgctgatagactgagtggggaaacccagcaaggcctgtctgtctagatccttcttggcctctctgagtagcattcctttctcctgggtgtggggcaggaccctctggaatcgggggtcttatgaactacagtcaaacaaagtaggtcgaagaactttttttttttttttttgagatggagtttgactctgttgcccaggctagagtgcagtggtgcaatctctgctcactgcaacctctgcctcctgggttcgaactattcttctgcctcagtctcccctcccgagtagctgggattacaggcgcacgccaccacaactggctgatttttgtatttttagtagagacggggtttcaccatattggccaggctggtcttgaactcctgacctcaggtgatcctcccgccttgacctcccaaagtgctgggattataggcttgagccactgcgcccagcccaaagaatttttttttttttttttttttgagacagagtttcgctcttgttgcccaggctggagtacaatggtgccatcttggctcaccgcaacctctgcctcccaggttaaagcgattctcctgcctcagcctcccaagtaactcggattacaggcatgtgccaccacgcctggctaattttgtatttttagtagagaggcttctccatgttaggctggtctcaaacttctgacctcaggtgatctgcctacctcagcctcccaaagtgctgggattacaggcttgagctgccgcacccggccaagaatttctttataaccaatttttacacagaaaggcggagggaaagttagagtcgtatttttaggttttgtggctggctttggggaggagttctggtttctgtgccccgctttggggaagagggattctatggtgcctccaggagaatggactgagagagggaggcaggagaaggtcagaggaaaactttttcttctgaggctgctgctgaggccatttgggggcactgttttctgagccccaacaaaagctagacgtggttccaatctgtcagccctttcccccaaggcatgctatgcctgagctggcatgtgggggaagtttgaggcacagttgtgccaagtcatatctgatcccagagagcccatgagcaagactgggtttcaggaggcggtcccttgggaagagcccagcctgtggactctgggcgttacttaactcctctgcctcagttacctcagcttcaaaacaggggtttagaacaaccagtgcttcctagaagtgccgcagggcttcagtgactgaattcatgcagtgtttggcacagtcctggattctgggtaggaagtgcttggtggatgttggcaggagccatcctccccaccggcagagcagcatgtctcactcactgtccctgctctgccccattacaagcaggggcttccagctgggtgcggtggctcacacctgtaatcccagcactttgggaggccgaggcaggtggatcacttgaggtcaggagttcgagaccagcctggccaatatggtgtaaccctgtctctactaaaaatacaaaaattacccatgcatggtggcgcatgcctgtagtcccagatactcgggaggctgaggcaggagaattgcctgaacccaggaggcggaggttgcagtgagccgagattgtgccactgcactccagcctgggccacagagtgagactctgtctccaaaaaaaaaaaaacaaaaacaaaataagaagcaggggcttctgtccccttcgtttagtccctgtgtgaggaggaaagaaacttaccattctattctagtttcagctgccttatctgacttagggagccaggtttaaataatcacatcgtccttctggctgagttctgattaacatcggcatcttttggttcacgatacgtttttgagacaaaactgcctgagtgcgttcaggctactgtaacaaaataaccagagaccaggcagcttataaacaacagaaatgtgtttctcacagttctggagactcgaagtccaagatcgaggtgccagcagattccgtggccagtgagggcctgcttccccattcacagatggccatcttctcgcggtgtgtcctcacatggtggaagggatgagggagcctctggggtctcctttcacaaggacactcctctcacctcacctctcaaagctccgtctcctaacaccatcaccttgtgggttaggatttcaacatatgaacttgggccgggtgaggggcacacattgagtccattgcaaaaatatatccaagctgtgagcactggcctttgttgtcaaggggaggaaaacacaaggaaggttcccctctgcagactgaagtctgagtcacagaacctgaagaaacacatgtgcttccctctctaggctgactcttagacttgtcccattttccattttttttccatctctaatgtatgcacaacagatgcttgagttaaattgaatggtgttgaatgctctctggataatggctttttttttttttttttaaaccagacttttggaacacctagttgaaaaagagagagagtaccagaatcttctgcggcaaactctagaacagaaaactcaagaattgtatcaccttcagttaaaattaaaatcgaattgtaagtcattttccaatgagacagactttaacatctagctaatattctagttagctttgaagaaacatttgaggttatcttctgttaatccaggactccagtagattctagactacttctcaatcataaaaagggactactgatagattcaacaacatggctgcattgtaaatgcagtatgctaagtgaaagagctagattcacagccagcaccgtagctcgtgcctgtaatcccagcactctgggaggctgaggctagcagatcaattgaacccaggagttcaggaccagcctggtcaacatggcaaaaccccatccgtacaaaaaatagaaaaaaaccagctgggcttggtggatgcatgcctgtagtcctagctacttaggaggctgacatgggaggatcacctgagcccaggaggttgaggctgcagtgagccgaggtcatgccactgcactctggcctgagtgacagtgaaaccctgtctcaaaaaaaaaaaaaaaaaaaaagattcaaaaggccacataccatgattccttttcctccagaaaaggcaaaactacagggacagaatcagaatggggaggtgacgggactgattgtaaagggcacatgaggacttttgggagtgacagtcatttctgtatctgtgctgccaccttcatagcacattggacacctaaaaagggtagtttactgcataagtaaataaatatgcctccatcaacctgacattcgttttgggccacttagaaacgagctccagagctacctcttggaatgtggactagataagctctgacctcaacactaaaacctatttccttgtaggatttccagtgcagttagggatgtgattcctaaggaaaggcatttgaaagatgtggggataagcatttaaagtggtagacctaacatgtcaaattccaaactaactgaaggtatcctagatgaggaggctttctagaaagtgaatctcagaattatgaattgtgtaatacgtattagcgtggttcagtgatacagggttaattcatctctttttcacatcacatttacattctggaatcatttattaatccaactggttacttttgaagagttttatggttagactaatatataacaaattgccaatcgttacaggtattacagagaacccagcaggcccctacgggcagagaacagataaagagcttatagactggttgcggctgcaaggagctgatgcaaagacaattgaaaaggtaaatttacaacaaagaaattcttatgctgttgttacacagctgctcagctcttaaggatctgatctttgtttcagattgttgaagagggttatacactttcggatattcttaatgagatcactaaggaagatctaagataccttcgactacggtaagagcctcaaaacagtttgtataagagaatacaactttttatgtgtgaatatgcttcaagagcagaaaacaaagggctgggcctccccccaaactctggagttctattaggttcaagctgggaaaaagccaaggtggggcagaaactgaaagccaggcagaagtcagaaataggaatgtgacagagaagagctggccaatctcctgccattaatgcctggctgggagtgggtggaggcacatggcaagcgtgcctgcacgctggacccacccccttctttaaactgcagcctgccttcttgttcccgagtcatttgaaatagccagctctctgcaggtacgtacctctaaggccatgtcctactactgctgggacacgagcgtcacctccatatgtgaggagaatgtttttattttcattaggtttttaaattagggactgcagttttaagctctgttggcttgaagcactgactctgaagacagctgtgtttgtttcccaggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgt

SEQ ID NO: 3207 - DNA, 122220 bp, human
ctttgtgtgggcacattttttttttcctcttggatacatacctaggaatggaattgccaagtcatatggtaaatataggctttttttttttttttttgagctggaatctcactctgtcgcccaggctggagtgcaatggcgcgatttcggctcacggcaacttctgtctcccgggttcaagtgattctcctgcctcagcctcctgagtagctgggattataggcgcccaccaccacgcctggctaattttttttgtatttttagtagagatgcgatttcatcatattggacaggctgatctcgaactcctgacctcaagtgatccacctgcctcagcctcccaaagtgctgggattacaggtgtgagccaccgtgcctggctggtaaatatacctttaatttcttaagaaactgtcaaaacaattccaaagtggctgtaccattttacatttccaccagcagtgagaggtccagtatcttcacatccttgccaatacttgatatcatctgtctttttattatagccattctagtgagtatgaactgatacctgagtgtacttttagtttgcatttccctagtggctaataatgttgagcatcttttcatgtgctgattggtcattcatagtcttctttggtgaaatgtctgttcaaatcttttgcccgtttaaaattgggctgtgttcttattacgaagctgtgtaagagttctctatacattttggaagcaaggcccttattagaggttttatcaattatttcttttatggatcgtgcttttggtatatctgtgaactcttagcccaaaccaaggtcatgaagtatgactcctatgttttcttttagaagttttatagttttagctcttacatttaggtctctgatccattttgagttaatttttttgtctggtgtgaggtagatgtccaacttcattctttctcatttggatccctagttgtcccagcactgtttcttaaaaaaaagaaaaaaaaaaactgtcttgtcatctttgaatcatctttccaccctcgtcaaaatcaattgactgtatacgtaagggtttatttttggactctcaattatactccattgacatatgtgtctactcttatgctaataccacactggtttaaaacttttttttttttttttttttgagacaagttctcgctctgtcacccaggctggagtgcagtggtgcgatcatggctcactacagccttgacttcccctggttcaggtactccttccacctcaacctcccgagtgcctggaattataggtgtgcaccaccacgcccagctaatttttttattttttgtagagatggggttttgccatgttgcccaggctggtctcaaactcctgggctcgagcagtctgcccacctcagcctcccaaagtgctgggattacaggcatgagccaccatacccagcccttttttttttttttgagacagagtttcactccagcccaggctggagtgcacaggctccgctcactgcaacctctgcctcccgggttcaagcaattctcctgcctcagcctcctgagtagctgggatcacaggtgcccgctaccacgcacggctaatttttttttttttttttttttttaagtagagaccgggttttgcagtgttggccaggctgatctcgaactcctgacctcaggtgatccacctgccttggcctccaaaagtgctggaattacaggcacaagccaccgtgcctggcccgcacccggccctttttaaaaaatttatttttctttgttttttgttttgttttgagacagggtcttactctgtcaccgcagctgtggtgcagtagtgcaatcacagctcactgcagtctgcactattttgattactatagctttgtagtaatttttgaaatttggaagtgcgaatcctctaactttgttctttttcaacattgttttggccatttggggcctctcaaagttccatatgaatttgaggatcagcttttccatttctggagaaaaaaaaagccattgaatattgataaggattgcatcgtatctgtagattgcttggctggtattgacatcttaatagttttaagtctactaatctgtgaatgtgggatgtctttccatttatttaggtcttctttaatttatttcagcaatattttgtagttttccatgtacaggtctttcactttcttggttacacttactcctgtgtattttattcttttggatactcttgcgaatggaattgttttcttaatttctttttcaaggttgactttaaaaaaacacctgtcacaaaaatcttcaacactacatttcacttcatatttcagtatttgattgagttgaaaatgtaattgactttttggtcagagttctatacaaatggcttctggtttttcctgtattttcatccattttaattcttacactattttatactgctttggagatgacagagatagccactttctgcagtttatcactttagagaaaacatgtttatatggtgacagatcaaggctgtctttatgaaagtaaaagagtgaaaatacagccaaccccaaggctactttatctgtttaaccttggaacttcctagtactttgccactagtgtacatagtccataggcattgcgtagcttcatttgttttaattttccttagcaaggataatcatacctttatacttacagcttattttgcaggttgatttcctctagactcagactctgaggctgagtttagggtacaggaggtttattaagggatgcctttgggatggctgctggggaaggggagtaaatgaagcgggactggccagagggagacatgcagctgagatgcaggctcaatgacagctttggctgaccacattgggagggaggtctggagctgaaatggcctttctgagttgtcttgggttgggatgaaatggccaggcctctatgttcctccatttgtccttcatcactaggaatgtagcttggatgagatactctctggaactgacacagttcagaagggactaacagtaaggggctgcttcctaacgagctcccagaaactggggcaacacatccttccttgaggttgggttggggggttctgggtagtatacctgcatatccaccacattataattatttcatttgagaaatgtgtgtatgtatgtgtgtcatatataccccaagactaagaaatacatttccaaggcttagaggtactgctataatttttttccactgaattggtgggtaaattacctgaaagctgtgcatagccttgctagagaggcaccatggagacaagcaccttctctgtcccccaggagaattactgggagaaaacaaggtgttctacccaacacttgcagaaggaattgttaaaagtacattggactttattttcatttgtcatgtcctaaagccagagttcacagttgtttttttaaaaagcagagttaaatttccaagctaagatcacattattaaaaaaaaaaaaaaccttattaaaaaacacgttattaaaaaactaatctggttcttgacctctggtttaggtgattttttttttctggaaagccagtgagatttaagagaaactcattgttgccattaaaatggttatctttataatccaaataaattagaaattctttgaaaaacagacactggcaatattggagacagtgtcttcaatactcgaagtctctcctctggcttaggaacatgtgtaggtctcggtcagggtaacaatttctcctgtttttttcctcttgccattctcaggccttcagtttcctatggcttaggactcaaaatgatcaaagatgatatggattgcttagggacgctttggtagaaagacaattaagtttcttttctcttttctgtatcctttggattttctgagttcaaaagatttctagtacttttattagcaaagactcaatttcaaacaagaaagctacatctcataatagggagaattttattttactcacagaacatgaattatgtaaaaatctcagttggttctttctctctccctccctctttctctctccccctccttccctctctctctctctcccccttaccctcccccccttcccccctctctccccctctctccccctctccccctctcccccctctccccctctctcccccctctctcccccctctccccctctctcccccctctccccctctctcccccctctcccccctctccccctctctcccccctctcccccccctctcccccctctctcccccctctcccctctctctccctgtccttccctctctctctctccctgtccttccctctctctctctgtctccctgtccttccctctctctctctctctctctctccctgtccttccctctctctctctccctctctccccatccctccctccctctccctctctccccccgtccctccctccctctttcttctccctctccttcttttcttccttcattcctttttcttttcttttctcttttcttttccccttcttttcttctttttttttttttttctaacactcttgctctgttgcccaggcaggagtgcagtggcatgatcttggctcattgcaacctccacctcccaggttcaagcgattctcctgcctcagcctcctgagtagctgggattataggtgcccaccaccatgcccggctaatttttgtgtttttagtagagatggggtttaaccctgttggccaggctggtcttgaactcctgagctcagatgatctgcctgccttggccttggcctcccaaagtgccggggttacaggcatgagccaccatgcccagcccctttgcatatttattttatttttgtatgttctgttatttctgcctcatcttaggttgttagtctttttgtctttttgttgttgttgttgttgttgttcctgcctgtggtcttggtcctgtgtgttctcttcaattggagtactctgggtctgtgaaccataaaacttttctctgcacctcttgaatatcagaggggtaatgtcagatttcacagggccaatgtcagaaccaaattattcatatttaattctacctgccaactggatatgtctttcatatccatggcacccatctattttctttaaatcgagacataattcacagaccatagaatttgccattcactcatctgcttatgttgagttctttgtacagctttatttaaggatatttcagaattaagcagaagtggcagttaatgactagaatcctgggaggacaggggtagggcctgagattatctggctccgtggtcatctgtaggccagttggttaacctgctgggtcttggtttcttcctctgttaaatgagatgattttaatgaggtgacttttgagatttgtgccagctctgaaataatcctgtgactttgtgatggccattcagttgtgtaaacaaagtaaatcaactgtcacaacaggttaattagcactccatggcacgtttccagcagggatatcttcgtttacttttaagtggcaccgtatcctgattatcctgttgaaattgttatacagtttctgaatatttttttcctcctatgaccagataattagagaaaaggagtagtgtagaatgctatttgcgttgctctaaaaagaaaaccactgcatttttctggacaatgtatatatgtatgtatctagctggctagacaaataattatatctgttgagcctaaagcttatcttttttggagttgtgtcaacttggattttcttctacaataaattaactttgtcatacctggtcacatgaaataatataaaaaatccattgccccgtatttgttcatttgctccctaaattttcctgggaacaatcttctgtgttttttcagttgcggttttcactaagtatttgtgacccacttgtgttaaaagatataagctccaaagtatcacattgtgccaccagttgagatgtgcattcttctgaaagtgctcagaaatcagttcatcttgagtagtgttaagtggctttctatctgccttagatactttatttccctcttctcacttggccatttgttgactgattaaatgtttgtatcattataaaagatgttttctggaaggccaagccacaagtctcattatgaagttcgctggtacaaactcagacatatcatatttgctgcaaagaattaatttataaaccctgtgctgctgttgaccagctttgccacctgctgtgagccataaataaaaataagtgctggtgtaatgagggaccttggcttgtatatctttcttggccttcttggacctttggatgccttgcatggggtgcctgcggaaaagaaggaaaatatagccaaccccaaggctactttatctattaaaccttggaattttttagtagtttgccattagcgtacatagtccacaggtattgcgtagcttcatttgttttaatattccagctgtggaggagccagctgaggagcaaatcctaggtgtccttagttagtggccatgattgaagccaatggacaattgagtggaggctctgacatgctctgctcctgggctgtcctgaagaatctaggaagctgtttgcagatgggccttgcactgtttattcgtggagagctttatatgtgcagcccactgaaggaagtccgacattttaggcctgcagttaggatgttctacgtgaagcatctaagagtcacgattgggggtttttagccttttaggggtcacgggacccctttgccagtctggaggagcctatgggcccttcccagaatatgttttaaagcaagggtcctcaacccctgggccacccgaccgggccgcacagcaggaggtgagcagcgagcgaggaaagcttcatctgtatttatagctgctcccccattgctcgcattaccgcccgaacgctgcctcctgtcagatcagcagcggcattagattctcataggagcataaaccctattgtgaactatgcatgtgagggatctagtttgtgtgctccttatgagaaactcatgcctgatgatctctcactgtgtcccatcattcccagatgggaccgtctagttgtaggaaaacaatctcaggggtcctgttgattctacatcacagtgagttgtataattatttcattatatattataatgtaataataatagaaataaagtgcacaataaatgtaatgcacttgaatcatcctgaaaccatcctccctgcccctgcccacctggtccgtggaaaaatttttttccatgaaaccagtccctggtgccaaaaaggttggggaccactgttttaaagtgtttaaatacaaagaattacaaaggagacccttcatatcaaaatacagttatcaaaatattttaaagttatatataattatgtgcttctttactaatgtcttaaataatgagatcaaacagcagatcttaaaaactgtcataatatttggagtagtgatgggcataaaagttattctgagatctccgcaggaactgtaatgtgatatgaaaaagtctgtgactcctgttaccaacaaagtctcaagtctcaagtctactactagggtatgttacctacattccctaagtgagggaaatgttatgtttcagttgagggcaaatgatggcaatgatgtaatttttttctctttcaagttcacagacccccccccccaacctccaagaatgactggatctcaggtttagaactcctagtcccttctagaactattgcacatagagaatatttgtgcaaaaaaaaatggccatgattaagcctctatcatctaatgaggctgacactattatcatctccctcttaaagatgagaaaactgaggtttagatagatgagtacatttttcagggtcatccatttaggatgggatggagctggaattcaatccttggccctctgaattctttactacattgctatgcttgagttgagatgatactttgtttctatattgataaagtatttcttgttcaccacacttcacaaatgtgaaaaacaatactatccagttcagctgagaggacgaataaattagcatgcccttatacactgtgggtgggagtgtaaattgctccatcctttatgacagcagtttggtcaacatatattaagaaccttaaatttgttctagtaattttactcctgggaagatatccttaggaaaagatcacagtacaaagatgccatatgcaaagatgttcatctcagtgacacttacagtaaggaaatttcaaaacaaacaaagttaggcaatagaagaatggttaagtatcctatatatatttaccagatggtgtattaggcaggcatttaaaattatggcacttaagactatataattaagcttttgtaatgagtccttattaaaagcacctattatttaattgagtgatgacataggacagtcttttcatggtggtgatatttgtagatggtagtagttctggaaatggcaattgctaggtcaggaactaaaacctttagaggaaaaattcctccgcttcctatccccacgctgtcagagactagtggcttttccttgggcctctgacttcacttactatatcagaatcaccgttttggaaatatttggagagtgtttagaataggactttacattttaatgtggttagcatactggttcaaatacctctttatgtaggaaactaaactgcgtttgttaaatttgttttaatgagctggattcttgagatgtttccacttataaatgtaacaactacaaatagctgatcctagtttgctattgaacatgtgttatggtaatcattgtttttatttttaatttctggtctcttgaccaacaagagtctgaatgtgttccatcacttgaagatgtttaggtttattcttcctctttgtaagaacaaaagtactgtacttaagagcttgtgctttcacttggaagtctattaattcctttttaaaatgtagttgttagtcccaatttctgccaaatttcttaaactttctggaagactttcccaaaggaagtatttttaccttcccaaagtctccggattcctgctgtctcctcagtcctgttcattaaactcactcaactggtttcagagttcatgcatttcttttctttctccttatttttctctaactatggctaaacgtttgctccgtggatcagatcctctgctgactggggggtagacttcatcagtttctgctgctagtgctctgccttcttgaacagtatttctttttcaccaaagaacttgtgatggcatttaccatgtttgtcaaaatccagtttttcacacctcattatttaggatttgatcagaactctggggcaaagttgactcttgtaatatttgggaggactaggtttgctaaaggaataacgtcaaaatttcagcagaaatgtttgttttggagacagttgtaagacatataacaattctttacaaataggttagattcttgtatcttcaatttacctacctgttacagaagctcagggttatttaattgtaataagtatttttgtattatgtcttttaaagaaacagaataaaagagaatgtaggtagggggagagagagagttatattaacctttttatttaccatttctgatacttttcatttgttcctgtggattcaagttaccatttggtgtcatttccttattccaatatagccttgttcctaccaatatccttttgctgttattttcaaatgtattacatttctgtataagccgcaacacatgattataaacatcattttctgcaactgctttttaaaccagttaagagaagaaaagaggaaatttgcaattatactatcttttataattgcatgcataactacctttactggtattctttgttttttatcacgtgaattcaaattactatctggtgtcatttgctttcagcctgaagaaatttctttattattattattattattattattattattattattattatttttgagacagagtctcgctctatggcccaggctggagtgctgtggcgcgatctcagctcactgcaagctccacctcccaggttcatgccattcttctccctcagcctccggagtagctgggactacaggagcctgccactacgcccggctaatgttttgtatttttttagtagagatggggtttcactgtgttagccaggatggtctcaatctcctggcctcgtgatccacccaccttggcctcccaaagtgctgggattacaggcgtgagccaccgcgcccggcccctttagtatttttgtaagatgggtctgctagcattatctcagcttttgttgatctgaaagtgttcatatttcatcttcatttttgaaagatagttttagtggatataaaattcttggctgactttttttttctttcagcactttgaatatgtcatcccgtggccttcgttgtttctaatgaaaagtcagacattaatcttactggaattctcttgtatatgacaaaacatttttctcttgctgctttcaggattttcactctttatctttcaaagttaactgacacatctgggtgtggacctctttgcctttatcccacttggagttcatttggcttcttggatatgtagatttaattttttaaaaaatgatatctggggccgggcacggtggctcatgcctgtaatcccagcactttgggagaccgaggtgggtggatcacctgaggttgggagttcaagaccagcctgaccaacatggagaaaccctgtctctactaaaaatacaaaattagctggtgtggtggtgcatgccttaatcccagctacacaggaggctgaggcaggagaattactttaacctggtagacggaggttgtggtgatccaagatcgtgccattgcactccaacctgggcaacaagagtgaaactccatctcaaaaaaaaaaaatcatatttaggaagttttcagcaattatttctttgagtatttttctgctcctttctctcctcttcttctgggactcatattaggtgtcacatatgttggtgcacttaatgctgtcccatgttcctttaagactttgttcattttttctttttctgtcttgttcttcagattgcatatctctatttttctatcttcaagtttgctgattatttcttctgccactcaaattgcctgttgagcctcctgagtgaatttttcattttggctgttgtacttttcaacttcagaattcctaccccccctccttttttttggtaatttttctttatcttctgtgtttgagatactgttataataccttcctttaattctttaagtatggtttcccttagttctttgaacgtatttgtaatatctgctttcaagtcattgtctgctacatttaatatctgggtcctttcaaaggcagttagcattgcctactgtttttcccatatgtggatcacactgtcctgtatttgcatgttttgtattttttgttgacaactggacatttcagataatatattgtagaaactccagatactgatctttctcccttctgcctccggggcatgttgtttttgttgtttacttgtttatttgtttcatgacttgactagttcagtgaagtctatttttctgcaatgggcagcctctgatgtcacttctttttttttttttaatttaagttttagggtacatgtgcacaacgtgcaggtttgttacatatgtatacatttgccatgttggtgtgctgcacctattaactcgtcatttagcattaggtatagcacctaatgctatccctccctgctccccccaccccacaacattctccggtgtgtgatgttccccttcctgtgtccatgtgttctcattgttcatttcccacctaagagtgagaacatgtggtgtttgattttttgtccttgtgatagtttgctgagaatgatggtttccagcttcatccatgtccctacaaaggacatgaactcatccttttttatggctgcatagtattccatggtgtatatgtgccacattttcttagtccagtctatcgttgttggacatttggcttggttccaagtctttgctattgtgaatagtgccgcaataaacatacatgtgcatgtgtctttatagcagcatggtttataatcctttaggtatatacccagtaatgggatggctgggtcaaatggtatttctagttctagatccctgaggaatcgccacactgacttccacaatggttgaactagtttacagtcccaccaccagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgtcttttggctgcataaatgtcttcttttgagaagtgtctgttcatatccttcgcccacttgttgatggggttgtttgtttttttcttgtaaatttgtttgagttcattgtagattctggatattagccatttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaaaggtattgcctaggttttcttctagggtttttatggttttaggtctaacatgtaagtctctaatccatcttgaattaatttgtgtataaggtgtaaggaagggatccagtttcagctttctccatatggctagccagttttcccagcaccatttattaaatagggactcctttccccattgcttgtttttgtcaggtttgtcaaagatcagatagttgtagctatgcggcattatttctgagggctctgttctgttccattggtctatatctctgttttggtaccagtaccatgctgttttggttaccgtagccttgtagtatagtttgaagtcaggtagcgtgatgcctccagctttgttcttttggcttagggcattcaattaggaaaaaaggaagtcaaattatccctgtttgcagatgacatgattgtatatctacaaaaccccatcatctcagcccaaaatctccttaagctgataagcaacttcagcaaagtctcaggatacaaaatcattgtgcaaaaatcacaagcattcttatacgccaataacagacagagagccaaatcatgagtgaactcccattcacaattgcttcaaagagaataaaatacctaggaatccaacttacaagggatgtgaaaggcctcttcaaggagatctacaaaccactgctcagtgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatgatgtcacttcttaaagggcacactcttgggcatgcgcacagttattctgactcttgtatcctcacccaggaatgacagtagttgcagctaggctctctttgactgtctgtttccctgatctccctgttaagtttctgactaatcttctgtattggtcttacacaactggtactacactgagttgttagtctccctccttagctgattgttctattgcttttgacaataccttgaggcataattgttccacagtttgatacaattaaagttttgcaggaatagtccttaaaactaatccctaaggcttggtctgacctcaggaaggttcctcctagctgtctctttcccatttctctctgttaaacttctagctggtctaccctttacatattcctatcacagagctaccagccttctcttaattgccagccaccaaaatctccataatgttttgtacagcactcatgagcttaaacttccccatggcacattctgcatgaagtcactctccttgtgaagagctgcagttcttacagcctgcctttctcctggtcagagctctgtaccactgctgtggagatggcagtggaaacagcagtctgtttctcttggggtgacactctgctctgtgagtggggtgctggctgggggcaacagcctctagtcttctcagcttgcctctcttggcatagaaccttcattctgtgagggagctggggcagggacaatcaagtttcagcattcttggcctgttttttgtttgtttctttgtttttgttttgttttgagacggagtcttgctctgttgcccatgttggagtgcagtggtacgatctcggttcactgcaacctctgccttccgggtttaagcaattctcctgcctcaacctcccacgtaggtttcactgcaacctctgcctcccgggtttaagcaattctcctgcctcagcctcccaagtagctgggattacaggcgcctgccaccacacctggctaatttttgtatttttagtagagagggggtttcaccatgttggccaggctggtctctaactcctgtccttgtgatccatccacctcggcctcccaaagtgctgggattacaggtgtgagccactgcgcccagtctcttagcctgttttgcctagggtagagcttctaccctacaggtgtaggctgggtagagcaagggagccctggtcatcttgaccacacttgcctggaatagagcttctacaatatcaggctgcgaggaataagaatgttggtggcctggtcttctaaggagaaacagtgactctggaccagggacaagagggagcccttttgtcttggccacacctacttagagtagaacttcagtcagtctgggctgggtgtgggggcgggggagcagtttatggcccaaatgctgcagaatcttactaacaagatttagattttcttgaataaaatgtttttccatttgctacatgccctcaggacaacttatagagactttaaatcaggggtgttcagtcttttggctttgctgggccacattggaggaagaagaattgtttgggccacatgtaaaatacactaacaatagctgatgagctattaaaaaaaaagtttgtgtgtaaatctcataatgttttaagaaagtttacaaatttgtgttgggccacattcaaagccatcctgggccatatgtggtccatgggccccggttggacaagcttgctttaaatggctgtttaaaaagaattttcatcagttatggttgtctttctggggataggatctgggaagctccttacacttccagtccaactttaactttttgaaaataacaaatgatgtttcttcaaaggtatttttccttctagacctcactgatctacacagtccttttctccctctgtctgaactaggaagtctttgaccataacatcaaccaatttcaggtgtgtattagtccattttcatactgctataaagaactgtccaagactgggtaatttgtaaaggaaacaggtttaattcactcacagttcagcatggctggggaggcctcaggaaacttacaatcatggtggaagggggagccgcaggcaagataccttcttcacaaggcggcaggaaggagaagtgcctagcgaagggggaagagccccttataaaaccatcgggtctcatgagaactcactcactatcaggagaacagcatgggagaaaccgcccctgatgatcaagttacctccacctggtctctaccttgacacatggggattacggggattacaattcaagatgagatttgggtagggacacaaagcctaaccatatcaaggtggaagaaagaaagtttaacttttgaatatgtaaatggcatttaatttagtctaggaacatggctttcttggcatggatgagggagaaatttacctctaacttaccaaaaccttaatgctgaatgatttgagtctctttaagaacttgaaagtattacaaggccaggtgcagtggctcacacctgtaatcccaaccctttgggaggccaaggcaggaggatcgcttgagcccaggagtttgagactgcagtaagctgtgattgtgccaccgcactgcagcctgggtgacagagcaagaccttgtctcaaaaaaagaaaaaagtgccacagggaacagagagtctttgttcctgtggggtaggcaattcctagtggctgtgaagaagtagataggagcctgctaccccacttatcacacacacacacacacacacacacacacacacacccctacacacctgaatttttaccctttctacttacaacactggtatttgtgggttttggttttgttttgttttgtttttgatgtagtctcgctctgttgcccaggctggagggcagtggtgcgatctaggctcaatgcaacctccgcctcctgggttcaagtgattctcctgcctcagcctcctgagtagctgggactacaggcatgtgctaccacacccggttaattttttttttttttttttttaagtagagatggggtttcaccatgttggccaggctggtctcaaactcctgacctcaaataatccactcgcctctgccttccaaagtgctgggattacaggcgtgagccaccgcgcctggccagtatttgtgttttgacagacttaataccaatagctggtacccacaaggatggtctccagctgctgctttgcagcaggatgtaagtattctcagaaaaccaaccctattttcagggataatagaatatcagaagctttgtctaagacaacattgactcgtcacctgtttctgtatgtcctgggagctaagaatggttcttacacttattaatggttggaaaataacaaagtaagatgatgatttcaggacacgtaaaaatacgaaatttaggccagatatggtggctcaagcctgtagtcccagcactttgggaggttgaggtgggcggattgtttgagccctgaagtttgagaccagcctgggcaacatggcaaaaccccaatctctacaaaataatagaaatattagctgagcatggtggcacgcacctttagtcccagctactagggaggctgaggtgggagggttgtttgagcctgggaggttgaggctgcagtgagccatgttcgcgccactgcacttcagtctaggtgacagagcaagaccctgtctcaaaaagcagaagagatctgagactcattatattaatatatgcttcctacaaaacaatttttattccacaaagtttataatagctcacctatagttaaatgatcaaataatatgcctttttcatctatgctgaaagaaaaaacaatatgccatgttgcaatccttgcttatcaggaggttcatgttccctctggttttgggcacatataatgaaacaatgtgatttctgagatttaaaaccctaaaatttctgccagtgaagttcagagatacatacagatcagttcagtatttgaaaccaaatttttgtcatatatctacgtggtagagcttttgaaatcgagcggtttcctgttttgtgcctaatagatccatagtcgtattgaacgaattgttttcatcctcaagtattttctccatgcctgtcccaccaggcgccacctgcccagagcctacacttccacataagttactttctggaacatctttgtttcttttttccaggcatccagtggaaattattatttcatcccatacatcgtgacaccgtgcgctgattatttttgctgcgagagtgatgcccagagacgagcctccgagtacatgcagcccaactgggacaacatcctgggcccgctgtgcatgcctttggtggacaggttcattagcctccttaaggacatccacgtgacctcatggtaattcccatctgccaccagtaacccctggagactcaccaagatgtccccatttctttcagggaagcggtacaccttcaaatgaacagagttgctggagaacccactattgtcccttactggctcacttagctgggccactgaaatgaaaccaaaagagaatagaactggagttaagaagtcgggattgagcccgtgtctggccctgactccctgtttgatcttgacatgtaacttctcttctctctgattgttctgtctcttctagataagacaacttataggaagttgtcagtgatttttttttttttaacgatctctttcagctctgagatcctgtgtttcaagatgatttctgagcatggctttacactcgcgtggctgttggggctcttcatatatctcagcaaggtcattctgaccttacgctctcgtgctttaaaagccttcgtgcgttgagtggagctgcagctatcctcaggatgtactgtgctgtgttctctttagatttaggttaggtgaggtgaaatatgcagaagtgaataggtttagattggaatcttggcttagatgattcctacctgtgtagcactgaaatagtcagctcacctattggagcctcagtgctcaagaaaccataccttcagatgttattattgtgaaagtaaaagaaaaattattcttcttaaccaaaggatccagttattttgcttgcagccaatttaaaggatttattcctgtaagttgtgtcacaaggagaaggatttgtccttccaaaacaaatgaaaatcccaaacactggcagagctgacctgaaatgaaatgtagaggacctcctgtcacactgtggctcaaatagtggcaccctgaactgcggagtgttctattgtagtgttggtacaagggagacacttattaatggtctccttttctatcccgtcacctcttccctggatacagaccttcttctacagactttaatggaaaaggagattagaaacctaaacatgtgtgaccacatgccaacacagagagcaaatgggggacattttgtggcacattcctggaaaacctcatgcagtcatgccttgctaactgttgtctgattgcaaaacaaacacttgagtgaagttttatagaaagctctcccaataccatattttcaagtctgacaaggaggtagactggctagatctgccagatgatttaggtctttgcaagacatggattcaagtttgtttctcactcagtgtgtgtatgtatcagtaggcaaacaactcttgtgatttcatttagtttcaaagggcttgaaatacctattggtggattccaccctctgaactggcagtgtctgacaacagttagtaggaggggaagtggtgcttatagtttaaaacatctataacacagatggaaaggaagttttgagctcaagcgccagctctgatagatttataaagtctattttgagtcctgtgctggaatggcttggaagccatttccaagtgctcattgatcagcaacatcttccttggttacaggggcagaaatggctgcatgcttattacatatctgatgtccccaagccatactcaaaccagtgtttaatttacctaaaaggtactgttcttcttaggtttcttagtttattaaaattatttttcagaattacccttgaaaaataaggctgaagtataactttttacttatcgggctaacctaataacactttaatagcttcagtgcctttatagtccaccaaatgtgcaatggctggcatccaacttaatgactcattcaattagtgacagaattttaaacactggcagaatctgctaattttgttcattattgggatgatggcaattaacaaaaaaggaaatagaaaactaaagcaatgcattgatatttttctatcagaacccctgctgtgtgcgtcacttcattctttaaatgttaatggaggtcctcttgtgagcattggaccaggttatgtactgtatgtacacatatttggcattgttttgtaattattgaaagtaggcaccatttgttcttatcgtatctcatgttgtttttctctctttgaagactattattaaatttagcttactctctttttaatgaacagcctaattttacactctgcagttagtccatttcagctttgttttgtgtgtgtgtgtgtgtgtgtgtgtgtgtgtgtgtgtgtgtgtgtgttttagaccaagtctcactctgtcgcccaggctggagtgcagtcgtgcgatctcagttcactgcaacctctgcctcccgggttcgagcgattctcctgcctcgacctccgaagtagctgggattacaggcacccaccaccaagcccagttagtttttgtatttttagtagagacggggtttcaccacgttggccaggctggtcttgaactcctaagctcgggtgatcctcttgccttggcctccaaaagtgctgagattataggcctgagccactatgcctggccccatttcagcttcttaatgggacgacagtattactgcttggcagtgtcctacctccacttaaaaattcctatggaaaatagacaagatattttaaatcaatctatggttgttgtaactcaacttatgtataccaagttaggtcatttttcaaggttttaaaccaaataccagataatagcattggctcttcaagagactatggtgatattccagcgtgaatttaactgctttaagtgtttttaagcttcctcgtgcttatctagctgctcacctgagggaagttttgtgttttccattagaaaactattcttgggtccaggcatggtggctcacgcctgtaatcccagcactttggaaggctgaggcaggtggatcacttgagtccaggagtttgagaccagcctggccaacatggtgaaaccccgttctggctgggtgcagtggctcacgcctgtaatcccagcactttgggaggccgaggcgggtggatcacgaggtcaggagatcgagaccatcctggctaacatggtgaaacctcatctctactaaaaatacaaaaatttaactgggcatggtggcgggcgcctatggtcccagctactcaggaggctgaggcaagagaatggcatgaacccaggaggcggagcttgcagtgagccgagattgtgccactgcactccagcctgggcgaaagtgcgagactctgtcttaagaaaaagaaaaaaaaaaaaggaaagaaaccctgtctctaatagcaatacaaaaattagccaggtgtagtggcacatgcctatagtcccagctacttgggaggctgaggcaggagaatcgcttgaaccagggaggcggaggttgcagtgagctgagattgcaccactgcactccagcctgggcaacagagggagactccgtctcaaaaaaataaataaaaataaaaaaaaaaaaacaaaaaaacaaaaaaacagaacatctggccattcaatatggtgaggagagcaaggctgtctgtaagtttccaggcatgacctctgtgtgtcccatcttgtattgctcagggactcaacaccagtttccagccctcacctcaattggggaaagcttcatgactactaatgagagacacctgatagagaaattcattttcaagtcattctcatgtatgtttcatgggttttggagctccgtttggctttgttactagtggcgaaaataaatacacaaggaaggtaacttctcaccctctatatgtttgaaaatgccggagacagtgggtttggttggctgcaagttctgtgtgttgtccaagtacagatgggagtcacctttgaaagtatcttcaaggttgaatgaactgatttttacttgtcattcattggtctataaaatgtgaataagtagaaagcatcttctgtttgctggtgcagggaggctcaggtctgggccgaggtccctatgtgttagcctaagtcaggtcaatgagaaccattttgggcgcaagacagtcctgggtgcgtgcagatgtgactggaggattttgtgtttttctttctatagtgtttattacaaagaaaccttgttaaatgacatccggaaagccagagagaaataccaaggtgaggaactggcgaaggagctagctcggatcaagctccgcatggataatactgaggttctgacctcagacatcatcattaacttactcctgtcctaccgtgatatccaggtatgaaatccacctagccgaggctcacgtatgctacgttcttccttggcttgaggaacgtcttgtgaagtatttgtatactcagtatgtggtgaagtggctgggttttgttcttcttttttgttttcttttttgagatggagttttgctcttgttgcccaggctggagtgcaatggtgcgatctcggctcactgcaacctcagcctcccgggttcaagctgttctcctgcctcagcctcctgagtagctgtgattacaggcatgcgccaccatgcccagataactttatatttttagtagagacagggttttcaccatgttggtcaggctggtcttaaactcctgacctcaggtgatccacccgcctcggcctcccaaagtgctgggattgcaggcatgagccactgtgcccggccagaggtggccgttttatagacaaatggtatgtggctaggtcataggtcatccagcttatctgttgtggtggaaattttggagaaggttttgtcacatcggggctggtgtgaccactccgacaagaagagatgtcataaacaggactgtttggcagaaggagccaagaatttaagtttatatgaactttacactaggcattgtaccaagccctttgacaaacctgaattcatttaatcctcttaacaaccctatgtgggatatgtgtactctgattatccacattttacacatgaggaaactgaggcacagagcggttaagtaacttgcccgaggtcacacagcagttggttaggtcaggattcagactgagactgatgctccgttgtccttgttcctaacccctctgctgtgcaacttcctttaggcttttgtcacttcctcctttgtttaccaccatacatcagtgacagggagaacaggagtagcagaaacacattcaggacccagggaatgtagatgtttattctgagacaagcatcagaagctactggagagttctgagactggtcttttggtctgtggttccgtgaaggaaattgagcgtttcctctctccaagttgaatgccattgagccatctctaaggatgtcttggcttcctttcctttggaggaacacaggatcacgtaccttactcatagaattccacaaagccatgttgagagttgttggctagaagtctttaaattgaagtgatggaggcgtccacttatgacctggaccaaaacagagtcaaccagtaaggaactcctgcccctggtgataaacagatgcagctagctgattttatttctgtttttcaaatttttatttatttatttatttattgagacacagtcttgctctgttacccaggctggagtgcagtggtgtgatctcagctcactgcaacctccgactcccaggttcaagcagttctcctgcctcagccttcccagtagctggaattacaggtgcctgccaccttgcctggctaacttttttaatttttagtagggatggggtttcaccatgttgggcaggctgatctcaaactcctgacctcaggtgatccatctgccttggcctcccagagtgctgggattacaggcgtgagccaccgtgcctggccagctagctgattttaatagcagttgctactagggatgataatgattaggtcttgtctcccaggacaagaacatgggaatgacttttcttgaagcctttcttccctcgagctgctgctttttgtccttcccttcatgtatcccttcttttcataaccttccattcatgctcaaaggtgggccaagaggttcttggaataccctgccttctccctcctggggcagcagcatcaaggcgcagagccacaggacaggcatggcatttcagtgggaagccctgttctgctgaccatggctggctgtcagcaagttggccagttccaacgattctaagcctggctgaaagagtaacaggcggcactgctaagaggggacttggctgagacaagcatggtcgcaatttttctccaggtaattatgcagagtttagagcagtggttctcaacccaaggacttttttggcagtgtctggagacattttcagttgtaaaaactaagtgcgtgtgtggggcatgaggtgggtggtgtgctgtggcttccagtgggtcaaggccagcatcctacagtgcccaggacagctcccacaacagagaattatggtccagaaacgtcactagtcccaaggttgagaaacactagtttagattaatgtatttgattctggcaaaataggaaagactggaatctatgtgctttgactggaagtttgcttgtgtgtatttgtccagctcactttaacacacatctctgctgatactgtttttttattttgtttttgattttgagacagacggagtcttgctctgttgcccagcctggaatgcagtggcacaatcttggctcactgcaacctccgcctctcaggttcaatcaattctcctgcctcagcctctcgagtagctgggattccaggcgcccgccaccatgcccagctatattttgtatttttagtagagacagggtttcaccatgttggccaggctagtctcgaactcctgacttcaagtgatccacccacctccgcctctcaaagtgctgagattacaggtgtgagccaccacgcccagcctctgctgatgttgttaactctcctacactcagctgtttcctggctgctggcctcatttacttttgttgcctttggatgcttcatgccctttgatagcagggattccttctctgttcttctctctctcatccatcttattttctggtctttttccctcctattaaaggctacaagtaacttcactaaatgccctttgtaaggaagggcctgtctttaagtgcggaggctgtctcctgtttataacaattcagaaaaatcagtgaagagctgtgtttcctctcttgctcactttgggacctcttgccaacaggactatgatgcgatggtgaagctggtggaaacactggagatgctgcctacgtgtgatttggccgatcagcataacattaaattccactatgcgtttgcactgaataggtaagaacgataatgtacgtacaggttttgaaacatgccacccattgaattgtgcttccttctttcattcaacatcgggtatgagccaggtcacgtgctaaatgccaaggttatgaagatggacaaggtccagtctttgtcctcagggactttgtatttggcatacacattctagctgtgagattgaacacatcaatccatcctaatagcttatgacggcatcaaaacaggcacccccggcttcacatatcttgtaacacatacgaggtcacatctcttttttaaatcggtaaaatttgcagtcagtgaaatgcacagatcttaagtatatgatttgtgtttgataattggctatacacatggaaacaacactcccatcaaaaaagaaaacatttccatcaccccagaagttcccttgtgctcctttgcaggcaatccttaacccctccataggtgaccactgttacagcctctgtctccatagatgagtttggcttgtccttgacttcacataaacggaatcacacagtgtgtactcttttgtgtcattcatcgtcgtgttcgcgagattcatctatgcggttgtgtgtattagtggtttgttcgttctcattgccgtcgcgtagtccttggtataggtatgccacaatcatctgttttactgctgatgggcctctaggttgtttgcggtttggggatactgagaacagcgctgctatggacattgctgtacatgctttttctacacatatggatacatttctcgggtatatagcatgtgcttgtagtagacatcggcaaacagtggtaggattctgattcctttttgggagaaagcttcatggtctctgtggaaatgcacctgctctctccccagcagcctttaaacccagcatcccaaggatgcattgttgtgaatgacggccagtcttcattaagcctgataaagtcttgtaactttgttcccccgacatagtaagctccattcttatttatatttacctgtgcttgattaataaccattaaatgagccatcacgcctgaggttcttgggagagtgcctggcacactgtaagtgctgtaaaaaattggtttgttaaataaaaactataagggccttttaagttactcatcactaagtctttttcccagacatagtagaggtaaccgttgtcagacagagaatgaaataatagattgccattttctcaaaataacaaaagagtaaaacaagatttgaaatggaaaattggggccggccgcagtggctcatgcttgtaatcccagcactttgggaggccgaggcgggcagatcacttgagctcaggagttcaagaccagcctgggcaacatggcaaaaccccgtctctacaaaaaaaaaaaaaaaaaaaaaaaaaaattagccaggcatgatggcttgtgcttgtagtctctcagctactcaggaggctaaggtaggcggcttgcttgatcctgggaagttgatgctgtagtgagccatgattgcaccattgcactccagcctgggtggcagaatggagaccctgtttcaaaaaaaaaaaaaagaaaaaagaaaaaaagacatagaaaattggtatttaggagaaacaggtatagcaggatgaggtgatcctgagatgaatacgtttcccgtttggaagcagaatggctgggattgcacaccagatagccacctttctctttgatgggtcttttccttctagtctgattatctcctgttagacagtggctctgtttaatagggccagacggggtctccaacactgagaacctcattttctccaacaaactaaggattttctatgggattgcaatacttgcttcatttacacatgtaatctgatcctgaatttcacatttttgctttaggcttaagttggccagccgtcaacatagtaggagtttgcattacacattgagcatctctaatctgaaaatctgaattgaaaagtgctcctaaatccaaaactttttgagcgccaacatgatgctcaaaggaaatgctcattggagcattttgtatttcaaattagggatgcttaactcgtaagtataatgtaaacattccaaaatctgaaatactgcaaatccaaagcacttctggtcccgagcattttggataagagatacctaactggtatatatagttttgagcgagtttatggcattactttgtatctgtaaaggggaaaatagtgatggacaagaaatgagttttcctgcatgaaggttgacctttagctctcaggaagtggagcaaatcatggccagaaatgagttactgaaggttggcagtaatggatgactttcgaccctcagatgtcaagggctccctgttagtgggaaagctggctcgagccggtcagctttccctgataccttccactccactgcgttcagaagcccattcaaagctacttcaagtttccactgagcagttaaactgcttgctgcttgatggcatggaatattttatgagtgatttgtatttgctgttgcttttacaaatggggctttattagatatatgaatgtagtcagaatattctgaccagggatccagccagtgagctggatggtctagaagaagaaaatcagaatcaaagtcccaggttcaaaacaaaatagaacttgccagtcgcaaaatagaaggcatgtgctcatattctacttccagcatctttggatcgagactaccaactctggcaaaatttacctctttgaattactcagcaagtggcagggcagttggatgtgtgacgcactgactggaatgtctaatatgtcgttctgtaaataaggggagtgctagatgagaatgctctgcagaccctagaaatgtgtgcaggggacatgagatgaacgtgactgaatccagcccacaccagaggggctgcatgcttgttccagaacctactgtattcacctgagccttagtctctgagcttcccagccgagagggcagagtgagctcgtcatctctacagtagccacgagcctccttttgtctcttctgttgatgttcgctgtttgatttcgctgtcttaatttccatgtggatataagtagcattctttatgacatgtttgtcaaatgtagaaaaatgatgacatcttcccacttttctaatgcattgtctccaggctcctaaaagcatcttgtgaaagaaggatacatacttgttgcttttctagtgaagagaaccacaaaatctgccaacttaaaaggaatcatttagtccaaatcctttgttttggagaggagaaagaaacaaacaaagaaaaaggcaagggcccaaaatgtaacacttggtcaataagagatctggaaccagaactccctccctaatgttaccacagcacactgcatatactacttttttttttttttttggcctgagacgctcactctgtcgcccaggctggagtgcaatggcgtaatcttggctcactgcaaccttcgcctcccgggttcaagcgattctgctgccttagccccctgagtagctgggattacaggtgcgcatcaccacgcctggctaatatttgtattttagtagagacgaggtttcaccgtgttggccaggctggtctcaaactcctgacctcaagtaatccacccgcctcagcctcccaaagtgctgggattacagacatgagccactgtgcccggccttggtttggtgtttattgtagcaaaaaaatacatataaaatttaccatcttaaccacttttaagcatatagttcagtactgttaaatatgttcacatatggtgaaacggggctctagaagttttcattttgtaaatctgaaactatgcacacattcattaaacagctgcccgttgctcccttccccagtccctagcaaccaccattcttctgtttctgtgactgtgactatcccaggtacctcatataagtgaaatcgtacagcactactgtccaatcttttggcttccctgggccacattggaagaagaattgtcttggaccatacataaaatacactaaccattgctgatgagctaaaaaaaaaaaaattgcaagaaaacctcataatgttttaagaaagtttacgcattggtattgggctgcattcaaagccatcatggaccatatgggccgctggttgaacaaccttgtacagggtttgtctttctctgactgctttatttcacttagtgtaatgtcctcaaggttcattcatggttgtagcatgtgtcagaacttccttttcaagggtgaataatccattgtatgtacagaccacattttgtttatccattcatctgtcgatggacatttaggttacctcttgagtattgtggatagtgctactattaacatagtgtgcaaatatttcttctagaccctgcttccaattcttttggatatatgcccagaagtaaaattgttggatcatatggtagtcctatttttaatttttttctttttctttttctttcttcttttcttttcttttcttttcttttcttttctcttttcttttctctcttctcttctcttctcttctctttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctcttctctgacagaatcctgctctgtcacccaggctggagtgcagtggcatgatcttggctcactgcaacctccacctcccaggttcaagtgattctcctgcttcagccacctgagtagctgggactacaggtgcacaccaccacacctggcgaatgttttttggtagagatgggattttgccatgtttcctaggctggtctagaacccctgacctcaagtgatccacctatctcaacctcccaaagtgctgagattacaggcatgaaccaccatgcctggcatatttttaattttttgaggaatctgtaaattgttttccatcgtgcctgccccatttacatctcaccagcggtgtacagtttctccaatccttgccaacacttattttctgttttcctttttttttttattagctgccctaatgcgtataagatgatagcctattgtagtttcaatggacgtttctctgattagtgacactgagcatcttttcatctgcttgttggccatttgtatattatctttggagaaatgtctattcaagttctttgcccaattttttaaaaggttatttgatttttgttgttgttgagttgtaggagggtttttttttttatatatatatattctggctattgactcccgatcaaatatacaatttgtaactgttttcctatattgtataggttgacttttcactctgttgattgtatcctttgatgcccaaaagtttttaagtttgatgtctcatttatctgatcttcttcttttttttttttttttggaaactgactctgttgcccaggctggagtgcagtggtgtgacttccgctcaaggcagcctccacctcccgggttcaagcaattctcctgcctcagcctcccgagtagctgggattaccggcacccaccaccacgccagctaatttttgtatttttagtagagatggggtttcgccctgttggcaaggctggtctcgaactcctgacctcaagtaatccacctgcctcggcttcccaaagtgccagggttacaggcgtgagccactgcacccggccggatgtctcatttatctaatcctgctttgttgcctgtgctttcaatgtcatacccatgaaatccttgccacatgtatactttttataacaaaaagccagttgtattttttttttttgataaatgaaccatcttatcttctgagcagtggccttgccaataatacatgttatcttttaaaaaaatatttgcttaaagggctctgtcttcattgctcctcactggcctccttgagcccgtgatatcttccttttctgtttccttcttcagttccctcctttttgtccttcctcctttatttactaacttatttatgtgtcagtagaagggctgtgtgtaaaggaagagggttcatgaggggtgactgaagttaacaggtgattttttaaaaaatcacgttttcaagtccaacagagcttaaaggtaaaataaaaataaaaaattacacgtgtatatttctctctcacacacacctgaacttatacaaacaagtgaatttgtttgattcaaatgaatttcactgcagtgttctgcattgattttggcaatgctgcctttattcagaatattatggcatcagtcagagaggaatttttttctttggaattgccagctttctttatttttttcgtctcctctcccttttctcctgtcctcttctcctcctctcctctgttgtccaggctagagtgcagtggtgtgatgatggctcattgcaaccttgactttctgggctcaagtgatcctcccacctcagcctcctaagtaggcacatgccaccatgcccagctaatttggaattgctagctttcaaggcacataggaaatcaatatcattccaatgggttctgaagacagatttgggttccagttcctgcttctgtactttattgttatggccgtggtcaagtaatttaacctcctcaaacgttggtgtccccatttataaaatgtgatactgacatctaccatgtagtatcacttggagtactcctggcacgaagcaggtgcttggctattgctcttactattactgtgtagcttgatcacccatattttttctaccaggtttgagggataacttttgaccatttccaaataccaaaactactagcaaaatacagagattgccaccacagacaatatttaaaataacatacctttggctctgaaaaaaaattcttaagagaaatttatagaagtgcttttagcaccagaacatcgttctaataagtctctggccctctgagatgactattttgcgtgggacagggttgatctgaatataggtatttgcagaaaaaagcgatcgtttggtaaattcaaagtttattgatttagagtgggtttcttcaccttggcactattgatatttggagctggataactctctgtcatgggggctgtcctatgtatagtaagatgtttagcaacatccctcgtctttacccactagatgccaataccactccccccgcacctcacccaatgtaacaaccaaaaatgtctctagacattgataaatgtcccataggggacaaaaatcccttctggttgagaccactgatttacagggaggcatttgaggtatagaaaaagtgcacgctttgacatttgcatcaccaacaatatgatgttgtcaagctaattaaactccttcagcctgaatttgttcatctgtaaaccaggatggtgatgcctaaataagatatgccatatgcaaatgactgcacggcccctggcagctagaaggcagttcataaaagtttgatagctcctccatttatccctcatttacacttcttaattctaatcgggagataacctagtgttacataaaaagattacagagtcaacagggcgagtgccaagtggcttagtctgtaggaattatggttgcttaaagtagacaagaaaaactgcttgtaatgtggccaaaaagtggcccagagctcttaactggctgttggtcacccagagagcattcaacttggggaatggtttgagaaatactccaaaactgctctactgtttacaacccacaaaactgtggactggactgctgggaaaaaaaagtagaatggtgggaattaatttgaggctttaaaaattaaataatatcataagtaaaatattagcatagtgtctggtgcctagataatgttggatgaatgttaattgcccttctatttcccaccagagaattccaaccaccagtgttaggtcatctccaatgatagtctgaactgaaaacaatgttatgaccaagttttctatcagcctaagaaaatgcaacactgagagagctaagactaatgaatacaatgcgtaaaggactttaaaataaaatttttccatacctgacatcaaattttttcatcaatgagatttaagaacacagttccttatgtttttctcatgtataattttttttcggggacagggggggaccttcctccagtggtttaaggtattttttcccccataacagtaaagtcaaatacaggagacattgttttaacatatctttgtgactgggcatccagaaaattggttaacactgttaacagccctgccaattgctcacttgattgttttgaggctcatggtagcatgtattgcagttaccagcctcagatatcagttgaggacataaggactgggaatttatttgtaatacattttgacatgcagggtaaaccgttaattattaaccattcctgaggaaaatcctgacccatgtaagttgctaccagggcctccgcttggcactctgaatcaatcgcatgtggacattccctgttagctgcattgtgaagtcctcgttgccacgttgagtcaggaagaccaaactggaagttcaggagacactaaccctggaaaagctgccttctcgcccgctgcctgaggatttcaaacaaatgagaaaagccacagttccacttaggaaacattgactttcctgtagattcagcctcctacaccttagagcgggtgttgagagacttcacatgcgttcatccctgtcgctgttgtccttgagataaggacattgataaagagaaggtgggagacatcctttcagattttcgtgggtttcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgcttttagccgggatggtctccatctcctgacctcgtgatctgcctgcctcggcctcccaaagtgctgggattacaggcgtgagccaccgcgcccggcctcgtgggtgagtttctaaagagacagaagggccactaaatcaaccctgtataacccccttctaaattcaggatggcaattcacattttactttagatgaaatattatcagtaagtgagtttggataatgcttcacttaagattcagaacagttgtgtttcagtgtgtttgaacactttgtagtatatcacagctcttatttcagcaatgtagggaggatacgtttatgcctgtgttgaaggacttgtaaagaaaggactttgtgttgtaggaaaagtgttggtttgagatttaggcagcctgtattctatcccagttctcctcctaactagctgggtatctgtgggcaagtcactttacttcccaggaattagtagaagtggacatacagaagacaagaaataaaaagggccaagcacagtggcttgcacctgtaatcccagcaactcctgaggtcaggagtctgagaccagcctgagcaacatagcaagaccccgtctctacaaaacaaaatttaaaaattagccggtgtggtggtgtacaactatagtcccagctactcaggagactgaggcaggagtagcgcatgagcccaggaggtcaaggctgcagtgagctatgattgtaccactgcgttccagcctgggccacagagccaggccctgtctcaatcaataaatcattaagtttaaaaaataaattacctaattaatttttaaaatatataaataaataatttttttaaaaaaaggaagggaaggctgtaggctgggtaccagttccagttgaggttgtctctttagttgtactccaggtgccagattacaagttcacccgatgccaccccgtgtatttcagtggttgatgtttgataagaccggaggttaagatgggctctgactacagtgaacagtccagtttagcctgactgaagggtttatttaggtgatagggagaaatagatggctgaggagggaggttggccccaggggttaaggaccttgactgataagctaaggaatttgaattttgttctgtagtccctagggagtaattactgaaggttttgtaaactggactgacatgagccaggttacgactccaccactatctgcatggccttaggcaggtcaccaaactttcctagacctagaccttatagtcatcttttttaaagagagagagagagagtgatttggaccagatgattttgaatattgctctcctttcaaaagttctgagtctataacttgaagcatcattttattagttgaatgattagagacagatcctttaagaccttgctttatgatggattctttatcctatcagcgatctatctcagtcctatttgttgttgtaaactcaattacgtcaccgttcccagggagaggaaaacctactctgtgtgctttctcactttgcttcctagtaacacgttataataacggagtttttccttaaacaataaaagattttgttagaacgcaggttaagtgaactaaaaggcacacatacagtttatttcacggccaaatgccaaattttcctcaaattatttgcccactacctcagctagtctctgtctagttttgttgctgttgctggctgattaatatttatttatttatttatttatttatttattgatttttgagatggagtttcgctcttgtcgcccaggctgcagtacaatggcatgatctcagctcactgcaatctctgcctcccgggttcgagcagttctcctgcttcagcctcccgagtagctgggactacaggcacctgacaccacgcctggctaatttttgtatttttagtagatattggctttcgctatgttggccgggctggtctcgaactcctgacctcatgagggtgatccacccgcctcagcctcccaaagtgcttggattacaggcgtgagccgctacacctggcctttggctgattaattttaaaagcaattttagtttgatatttccatcactaattttttttttttttttttttgagacagagtctcactctgtcgcccaggttggagtgcagtggtgtgatctcagctcactgcaacctctgcctcctcggttcaagcgattctcctgcctcagccccccgagtagctgaaattacagacgtccgtcaccacactggctaatttttctacttttagtagtgacgaggtttcactatgttggccaggctggtcttgaactcctggcttcaagtgatccacccacctcagcctcccaaagtgctgggattacaggcatgagccaccatgcctggcccctaatttttcttaataaaaacttttaatacatgtctagagtcataatctaggtctccccccaccccaaaacagcccctgagatacgaatttgggggcagatagtttatttgggagatgagcctaggaagtttcagaagggagacagggaaatgagatagggaaaagaagaaaggcagtagagggtatattaatgagcagatgaccactgtgtgggaaactgaggctgtatagtgttgaggagtttggggaggctttatagaacattctctatagaacaacatatagagttgtctcatccagtggacgaggaagctggggacctatccactaactctcagccatcactggttgagggctgccctgggggtgggacactcccaggggtagtggggagagggagaatggcagtggcactgggacccatcaagcctacaggtgagtggcagtgggatgctatcaggccattgtgtgtctttcgcacctactgcccttgtgggagttgatgttgttttaaatctctaatgccttctttttctgatcaactgtttttcttgaaatatcaatttctgaggagcttctgagtcttcctgtgttctgttttgtacagaattctggggagaatttaattttagtttcttgtagtttgttctgctctgcagaagatgccaggaatgatctaaaatatgtacacttcgagatctgttaccagaggtattgatgccatagttgcctggctactgtattgaagatttttccttgagatatttctttattcaaaagtggttctatttttttaatgcgtgattgagcggccaacgaatatcgttctgagcaggtagaaaagttttagtggcgtatctctggattttgcacacgtagatttggcttctcctcacagcagctcaggagaatcactgtagagagaaaactctcctgtgatccctccctttaagaacagatggcgatcttggctctgccatcaagccaaaggaaacatcagtgataaccatcagaggacctgtatgagatgagaaaattcctatgaaaaatgacctagacgcttactcttagcagcacactagaataggtctcgtggtgatcttaggtgacatgcactaaatattattttaacaacaatgccacttttcttgaggttttaaagaatagttgctcagcaagtcagatgaaaggaagttctcaccagcagccagcccttgggggattattcatggatggcaggaatgtgcagaaaaggattcaggagacatgaaggaactatccatgtgctagttttcctgtgcagctgggggtgtgaggatggcccggtaagtggagcacatttatggaaaaatggctattacttgggtatttgggggaaggcttcttgggaggagctagaatctggaaagccatttggagtgacatatgaaacctggagaatagctcctgagtcctttggagtaggaagttccttgattaggcagagcctttgagaaacttggcataagaggaatagaaatgactccatgtggcctggcccgtccctcccggtttgctcctctctagctgccctcatccgccttcagtcttagggcagcaggctgttctcagctgtggatgttagcatatgctgtgcccccgcccagaatactcgttccctcattgcttacctgactgaagctgatgatccttcagggtctagtttcagtgtctctttctgagaaaagctgatgttgcaaagaataccaagtctggaaaggatgttcctattgttactcattctcatagcgcttgctatttccctttatagcactccatttctgtgtttacttgcttaatacctatcatccctcctgctgtactataagcctgagggggcaggggccatggtgtatactaggccgtgatatagccagtgcctagtaacattgtgccacccacagagtaggcactcagtaaagatttgttgaatggggttgggcgcagtggctcatgcctgtcatcccagcactttgggaggtcgaggcaggcagatcacttgaggtcaggagtttgagaccagcctggtctacatggtaaaaccccgtttctactaaaaatacaaaaatgagccaggcatggtggcacatacctgtaatcccagctactcagaaggctgaggcatgagaatcacttgaacccgggaggcggaagttgcagtgagctgagattgtgccactgcagtccagtctgggcgacagagcgagactccatctcaaaaaaaaaaaaaaaaaaaaaaaaaaaagccgggcatggtggctcatgcctgtcatcccagcactttgggaggtcgaggcaggtggatcacttgaggtcaggagtttgagaccagcctggccaacatggtgaaaccccgtctctactaaaaatataaaaaattacccaggtgtggtggtgcgcacctgtaatcccaggtactcgggaggctgaggcaggagaatcaactgaacccgggaagtggagattgcagtgagccgagattgtgtcactgcactccagcctgggcaacagagtcagagtccatctcaaaataataataataataataatgataataataataataataataaaataaaagccaggcatggtaatacatgcctgtagtcccagctacttgggaggctgaggcaggagaatcacttgaacccaggaggcagaggttgcagtgagtcgagatcgcaccactgtactccaatctgggcgacagagtgagactctgcctcaaaaaaaaaaaaaaaaattgttgaatgggtaagtgaatgaagaagtgactaatgatcaactgtggtatagtattagaagagagccacataatgagtgtctgggtgctacagttaatttaaagtttggtagtagaaagtaaacgtattgtattttctttatttatatgtgagtctgtgcttaaaaacaaaaacatccaagtcagacatactcattgtatacagaaaaatataaaaacataattaccgttgataccactacccaaagataaccattgaagtagggtgtggcccaaagcagggaatgcagaaaagtagaggagtccacatgggctaggtcagggtcagtggtgatggaagtcttcctagcgtgagaatccctggtgtctgctaaaaaagggatttgataaaaactcagaggggaacagatcttcctgaccgagggaacccctgccgcctcggtggtgttgacttgtgtattaggctagtgtaactgttgtaacagacagccccacaatttcagtgacttcacatgatggaagtttcttttcactcatgcactattccaatgtggatgtatcctggctgggcagtctcttcttcaggtgatttcttggtgaactcagtctccttacatcttgaggctctgccctctcctggatcctcagatctcctttcagccagatgataggaaaagagcatggtgacttgttagagaggttttgtatctgtgtttggaacagctttgctgagatgtaattctcataccatacaattaacccattttggctggatgcattggctcacacctgtaatcccagcactttgcggggccaaggcaggcggatggcttgagttcaggagttcgagactagcttgggcaacatggcaaaaccctgtctttacaaaaaaatacaaaaaaattaaccaggcattatggtgcatgcctatattcccagctactcgggatggcttgagccctggagtcggaggatgcagtgagatcgtgccactgcactccagcctggacgacggacccaaaccctgtctcaaagacccaaaaaacaacccatttaaagtgtacaagtcggtgggtttttttagcatattcggagttgtacaaccatcactacgatcagttttagaatgttttcatcatcctccccccgccaccaaaagcccatacccattaccacttaaccccacttcccagcttccctcaattcttccccccctattcctaagcaatcactgatccattttggcaacctgttaatgggtaccccctcttcttccgcctcactctctagcctgaggaaaacactagtctcttttctgtctctatggctttgcctgttctggccatttcatataaatggaatcatacaatatgtgttttgtgtgtgtctggcttccttagcatactgtcttcaaggttcatccatgtggtatcatgtgtcaggacttcattcctttttttggcttaatattccattgtacagataggccacactttattaattcatcagttgatgggcatttgagttgtttgcacttttgactgtactagagagggttgtaggagcctgctcaggaagtgatgttcattacttctttccatgtttcatcggccacaagtcagtctcgtgtcctaatctcacttcaagggaacttgggaaatgtggtctggctgagtgcccaggaaaaaaagaaatggggcttggtgatgctgctacaacttgcaaataaggagtagagtttaactggatctatcagcgtggagattcctggtgacatgtcacagagcaggacagagagttcaggcaaggccactcttcagctcctgctgcctttgtgtgaatgggaaagccagcctgggaaatgcccagccccatcagagggcctatcagcccactgtagaccctggccttcacaggtggtgctttgccatcccaggagactgggaaaggttgggatgatggcagctagggtggatgatttcatggtgattgtgcctgatacataactgggtcctatttgtagagtagaaaaacaactattcggatctgtacgtttatttgactctgaacattgttcacactaagacacaggtcgcttctagttgttcccttccatgtatgtaaatacgaggcatctggccagagcagggcacctgctttcttgtggtaggtgtgtatttgtcagggtccaatcgggaaacaaagaccactctaagtatttaaaatagaagaaacttaatgtaggaaattggttacacaggtgatagaagagctgacaaaccaatcggaaatgatgaggcagccctgaagttagcatcagcaggaagctgctgtcacccgcttggctggagggacccagggaagaggtgatgttaccagagcccaggtgccaggatcacctggaacaatcgtgagccagcctggtgggagctgggtctaacaaagagatgtggctattgctggagtggccatgcacaccaagaaaaagtgggagaagaaactgcgctggcttcttccatcccatcctccagggcctcaccctctgcccccagtgcctcccaccggttgctgtcagctgagcacagcagcctagaggagtcagctcccctgtaacacaaagcagggctgcagaaaggccaagaatgcatttgagggcagaccccagtgattgccccagtaggacactattcagaattactgctcagtttctagtatttttaaagtcagctttaataaggtgtaacttacataccataggccgggcactgtgactcatgcctgtaatcctagtactttggcaggccgaggtgggaggatcacttgaggccaggagtttgagaccagcctggacaacacagtgagactctgtctataaaataaaaatgaaaaaattatcttgccttggtggtgtacgcctatagtcccagctactcaggaggctgagatgggaggattgcttgaggctgggagttgaaggctgtggttgagctatgaccatgccacagtattccaacctgggtgacagtgagatcctgtctcaaaaaaccaccatacaataaactaaaattttaagtgcacgatttgatgagtttggccaaataaacacacccatgaaactaccaccacaatcaagatatagaatattatatccctgtgttaggccgttctcatattgctataaagaaataccagagactgggtgatttataaagaaaacaggtttaattggctcacagttctgcagactgtacaagcatggcattggtgtctgctcagcttctggggaggtctcaggcaggttttattcatggcagaaggtgaaggcggagcaggcagctcatatggtgagagggagagtgagggccggtggcacgacctctactcactgcaaccttcaccttctgggtttgagcaattctcctgcctcagactcccgactggctaggattacaggcacctaccaccacacctggctaatttttgtatttttgtagagacagggtttcaccatgttggccagactggtctcaaactcctgacctcaagtgatctgcccgtctcggcctcccaaagtgctgggattacaggcatgagccactgtgcccggactcagtgtgatttttacatttgttggggtttttattgtcactacaggagtgaagacctttcacattcttctacatcttaattggaagcagaagtctcttgtaaggtttttgacaggtgacccaacacaaagtttattctagaaaggacactggtctaatgagaccttttgtgtgttaaagctcagggctggcttagaaggaggatttattgggattctatttgtctcttgccctatgaatttcctcttacagacacacagtatagaaaagagggccagggagacaggatggttgatggcaagtcagtgctctggcacacccatagctcatggcaatgctttgaggtaagcaaagtcagacacttcaggtgaaggactgaggcacagaagggctaagtgccctcctcaaaattcaattgggtaataaatggtgtgaaaatagccaggatctagctctatatgattcccaatccagtgttgtgtttttattctgtgcattttttacataagtaatagatgtgttggctcatgcctgcagtctcagcactttgggaggccaaggcgagaggatcacttgagcctaggagtttgagatcagcctgggccacatagtgagaccccatctctaccaaataaataaataaaaataaaagctaggtgtggtcatgcgtgcctgtattcccagcactctgaggcaggagtttcacttgagcccaggagcttgagcctacagtgagccgtgatcacaccactcagtgcattccacttgggcaacagagcaagaccctgcctcaaaaaaacaaaagtgataatagatgaatatgtttgtatattactgtgaaaaactgaaaaacaatccatttaaagcagttatccctctaaactctaatctcttgtcccgtccatattccggaagtaacctgtcttgtcagtttggtgtaatatccttggagacaattttctatgtactttacatactgtgaaaatatgtcatactgcagagtttttaaactataggaccacacaggaggtatactgttgtttttttcacatagtaatcgatgcttagagatctctccatgtcactacaataactgctcagttagtcattcatttaacagacacttattgatcacctactttgtgccagatccagttctaagtacagtagttaacaaatcagacccaaaaagtctccaccctctcggagcttgcattctaaaatggggagatagaataaaaaaaacctaaatgtattaaaacagtttagggtgatagggtagccagtaagtaggatgggaagattgtaattttaagttgagtgctcagagaagaccacacctattagaaagtgacatggagcaaagatcagaaagaggcaagggaacataccatgtggtatgtgggggaagatcatttcaggtagagggatcagcatgtggaacagcaaggaagcttgtgtagctggagcatagtaggtgatcggggcacaggagtggtaagagatgaggttggagaaataactaggaccacatcttgtagatccttacaggccattggaagaaaattggtgtttgctctaagatgggagccactggtgagttttgagtcgaaggatgacatgacctgccttacagcgcagaggatcactatgacttctgtgttgagactagatagtagagaggtaagtgtggaagcaggaaatgacatggcttggaccagagtggtaagggtgggctttatgaggagtgggtcaatttcagatgtagtttgaaataaaagccagtggaatctcctggtccaataaatggtgttagaggaaccaaacatgactgcaaagtttttggcctgagtaagaggaagaatggattggccatttaacaagaagaggaagactgtagaagaacaggtttgatgggacaatcaagagtttgatttggggccagccatggtggtgcacacttgtaatcccagcacttgaggaggccaaggtgggcagatcacttgaggccaggagttcaagaccaccctggtcatcatggctaaacgctgtttctactaaaaatgcaaaaattagctgggcctggtggtgcacgcctgtaatcccagctacttgggaggctgaggcatgagagtcgcttcagcctgtgagttagaggttgcagtgagctgagaatgcatcacaccattccagcctggatgacagagttgagactctgtctgagggggacaaaaaaaagtttgatttgggacacgttaagtttgaggtatcaacatgcaaatgagttgctgagagggcagttggatatgtgagtctggattttaggggagaggcctaggctggagatagaaatttggaagtcatcaaaatatggatggtttgaaaagtcatggcaatggatgatcaagggatctagggtagttaccaagaaagatgaaatgtccaagggtactgccaagggacactccaatgtgaaaagatcagagagatggactaaagtaggagaaaatcgggcgagtgtggtgtcctgcaaatcagatgataaaagtagtccaaggaggaaggggtgcacggttgtcaaatgcacatgtatgtgaaataggacaaggagtgagaagggagtggtggattcagcaatgatgccaacccactgacgcagaaagtccagcatgagaagcactgatgtctgggtctccagagattcagatttaagctcctaggtgattgaattttttttttctttctttcttttttttttttttgacatggcgtttccctcttgttgcccagactggaggacaatggtgcgatctcggttcactgcaacctccgcctcctgggttcaagtgattctcctatctcagcctcccgagtagctgggactgcaggcacctgccaccatgccctgctaatttttgtatttttagtggagacagggtttcaccatgttggccaggctggtctcgaactcctgacctcaggtaatctgcccgccttggcctcccaaagtgctgggattacaggcgtgagccaccacgcccagcctcccaggtgattctaatatgcagccaagattcagacccactgtcaaagtttccttctcttaattgtgaaatggccttaattgccagaaacagatgttgctggctgattcaacataggagtttttatctgtaggcttgttcttggataccttgggatctggaaatgataagcagatccaaaagctgattattaaccactaaagggattagctatttaacacctgtcttaaagtggcttttaagctgaaaatctctttgcttttaattttttcaaatgtttgatttttgttttgtttatactcaaaagactttttgttttgagtaacaagggtaaatttcaagttaatgagaaaattcaagggaaatcttgatgtaactggtccaaaaaactaaaatccaaacaaacctgagctcatatcactaattaggcattagcttgggcaacatggtgaaaccccgtctctacaaaaactacacaaattagccaggtgtggtagtacgtgcctgtagtcacagctacttgggaggctggggtgggtggatcgcttgagcctgggaggttgaggctgtagtgaaccgagatcgtaccactgcactccagcctgggcgaccctgtctcaaagagaaaaaaaaaaaaaaagcattcaagtgagtttattgagtttagtacattcttttcagaatcatgaatatttcacacctcaaaagttggctaattacagatgtagaaatgttgtgcctcataaaagtttcaatctttttcatattcttgccacagacattagaaattatttaaatgctctagtaaatttgagttggtatctgttggctcttaaaaattaaagaatattatacaatggctgtgcaacaagagatccagtttgcaggttagttcaattagattctatatgacaaaaagaggaaagataaaatatgttagaacaggatcaaggtagaaaatggaaaaagtccgagtcaaaatacaggcttaattattacaggtttccagaaggtcgccaagtgtctagattagccctttccaacccaggttgggttccacaagagaattaagtcctaatgcccgctggcatctattgtatgaagtgattgaatttctcttctgcatccggaatgaggctggctacgtaccatccttgggagcactgaaaaaatagtcactcaaataatcaaataattttttccagggattaattctgtcatggaaccccggttgagaaagtctggccattttagatactaatttgacatctgggatgatgcagtagtttttgaggtgcatgtcctcaggaaagaaaacataaaagagcctattgtggccgggcgcagtggctcacgcctgtaatcccagcactttgggaggccgaggcgggtggatcacctgagatcatgagttcaagaccagcctggccaacatggttaaaccccatttctccttaaaaaaaaaaaaaaaaattaaaaaattagctgggtgtggtggtgcacacctgtaatcctagctacttgggaggctgaggtggaagaatcgcttgaacctgagaggcagagttgcagtgagctgagattgtgccaccacactccaggctgggtgacagagtgagactccatctcaaaaaaaaaacaaaaaaaacctattaccaagaaattaaaaagaataatttattcacttattagaatggttattaataaaatatacccaggaccaccttgtataaatcccagcaatgattttctgaacattttaatatgtatccttacagacttttgtctatgtacattaacatgtgaatgtgtttatttcaaagaatggggtcatgcttttcatttagttcaggttttttccatgagatgttactgttacggatgttcctctgggtaattacacgtggatctgtccctttataatgattacgttattctgtagtctggttgttgcaaaatatattttgctgttcttccgttaatggacatctgagtcatctccagttcattactattacaagcagtgccataacaaacatctttgttcaaaaaattcttgaaaaaagatgtacatattacagattctagaagtggaatcgttgggtcaggatgggtacctgttttgtttttgtttttgtttttatcatgtaaaatcacaaatatatttaaaagtagggaatagtgtaattatcttaggcagggttctccagaggaacaaaccaataggatgtatagagatctagaggaagagatggattatgagaattgcctcaggtgattctagaggctggcaagtcccatgcaagctggagaaccaggaatgcttgtggtgtgatttggtctgagtccaaaggcctgagaaccagggatgctgttggggtaagtcctgaagccagaaggtccaagatccaggaactctgatgtctaagggcaggagatgatgaatttcccagttcaaaaaaagaaaattcactcttccttggcctttttgttctcttggtaccctcaatggattgcgtgatgccacctgcattggtgagggtggtcttctttactcagactcttgattcagatgctaatcttatccagaaacaccctcatagacatacccagaaataacgttttactagctttctggtcttccttagcccagtcaagctgacacataaaattaaccatcacaataataaacccccatctaccccatatccactttgataattatcattgcatggccaattttgttcccctttgcccccacccactcttttataccccaatgctggatttattacaaagcaaagacataccattttatccccagatatttaagtgtgtatctttaaaagctaaggacacttggctgggcacggtgtctcacgcctgtaatcccagaactttgggaggccaaggcgggtggatcacctgaagtcaggagttcaagactagcctggccaacatggtgaaacctctattaacattacaaaaattagttgggcgtggtggtgcatgcctgtaatcccagctacgttggaaggctgaggcacaagaattgcttgaactcaggaggtggaggttgcaatgagttgagatcatgccactgcactccagcctgggcgacaaagcgagactgtctcaaaaaaaaaaaaaaggttaagggcacttacaaaacatagtcatgattacattatcatacctaaaaatgaacagtttttaggttttatattatcatacctaaaaattaacagtttttctgtcagtgctcaaattttcccaattgtctttccttttcttttctttcttttttttttttttgttgagacagagtctcactctgtcacccaggctggagtgcagtggcacaatctcggctcactgccacctctgcctcctgggttcaagtgattctcctgcctcagcctcccaagtagctgggactacaggtgcctgccaccacacctggctaatttttgtagaggcagggtttcaccatgttagccaggctggtctcgaattcctgaccttaagtgatccacccgccttggcctcccaaagtgctgggattacaggtgtgagccactgtacccagcctcatatgttttatagtggatttgtttgaatcacagtccagactatgtatgttgcatttagttgatatgactcttaagtcttttttattatataggtttcctcttcacttattttttcatttccttatgatttacttgttgagatagaatcaagtagggactgagtgtaattgtataaggtttactggtgtggatcttaagcagtggctacattggaaaatgaaaactattatttagaaataatttttctgttaaagtacagcatccttgcacctgtctttcagcatgatgaatgcgtatatgtatttcactgtctttttaaaaaaaaaaaaaaaaaaaaaagcagggtctcactctgtcgcccagactggagtacagtggcatgatcttggttcactgcaacctctgcctcccagtttcaagtgattctcctgcctcatactcccaagtagctgggattacaggcgtgggccactaccacccggctacttgtatttttagtagagacaggttttcaccatgttggccaggctggtgttgaactcctgacctcaaatgatctacccgcttcggcctcccaaagtgctgggattacaggtgggagccactgcacctggcctctactccattgtcttgattgattcatttgtgaccttataacatctatctttcaggagaaacagcacaggtgaccgtgagaaggctctgcagatcatgctccaggttctgcagagctgtgatcacccgggccccgacatgttctgcctgtgtgggaggatctacaaggacatcttcttggattcagactgcaaagatgacaccagccgcgacagcgccattgagtggtaaaccctcagcccgagttatgagcacttgcatctcttcaaggaacagaatcgcataggctaaggatgtgcatctcttccttatgtatatgtctgtctgttggcagggagcaaacatttgtagtaaatgtggtctgggaattttcagattccctttttgagagaaaaccatgagaaacagggttttctactggtcacactcttcccacaggtacacttgtttatgggccaagaaggaggcccagcacactccttccgagctcccacttccagagccttgtccaccaccaccagggcatcatcttcccagtgatctgttcattcattcacttattcattcatttatttaacaatgttcagtgatggcttactgtgtgccagaaacttttctaggtggtggggatacagacacaacggacgtgaatcctgcccttgggggccttgcattgctggtgagggaagttaaagaaagtgacacattaggatgtcatctgagggctatggggaaaggttaagcagggaaggggataaaggagggctcggaggggtggtctgcaattttaaatagggtagtcagtgaaggtgcctaaagatagaaaagtgataagggagtgaacttcacagataactggagaaagtgttcttggtggaggaaacagcaagggcagagactctgaggatgaagcatggcaggcacactccaggatggtcagcactaagcaaggggtgagtggagagcaacatgaaacaggaagagggtaagaccttcttgctctgagtgagaaggaacatcaaatggagggtttgagcagaggagtgacaagattggacatgcattttaacaagagtactcactgttatgcaaagaatatattttagggagtgtatcagctatcacttgctgcgtaacaaccccaaaacttagcagcttcgaacagcaatgattatgatttttcatgattctgtggctttgccaggcacttcttctgctggcttcacctgggctggcttctaaaactgaagtcagctgtagggtcaggtgtggctggaagatccaaatgaccccgtacacatttggcagctggtgttggctactgatactgtaccttagctctccaccatgtggttctaatcctggtagaccagctttcttacctggtatgcagaactctaagagagtgaacaagggagcagcaaagcctctagaggcttaggttcgggaactcacacgtggttacttctgccacatgctattggtcaaagcaaatcacaaggtccgcccacattcaaaagggtggaggaatgtgctccacctctggctaggaggaatagcaaagttgcattgcaaaggtgcatgcatattgcgatgggaggaatttgtggccattaaacagtctatcacagggacaaggacagaagcagggaacaggagaatatagcagtaattcaggggagagctggtggtggcttgagccagggtggtggggacaaaaatgttgagaaagttggatgcaggatatattccgaaggtggaaccaacaggcccacatcattcatttccatcataagagctcttgacattgctgttctgctttcattcaattctaactgcttcctctctctctctctctctctctctctctctctctctctctctctctctctctctctctctcttcctttcatacacacaggaggctctgtcctccccaccttctctccatccacacttacttctctgacaatcccagccactctcacacctagggacccttagctggagctctccaacccaacatcctaagtgatggccttacacctccccccctttgtccacctgttctacctcaagatgatgttgatatttcagactcaacattttgaaggctgaagtcatttactcttctccacaaggtatggcttccaatgtcttactttcttactactattctctaccctcctaggtctaaactttcagtcagtgttggattcattttgctcacttacctccccgtccagtcaggccccatttgcagcccttctgcgagccttctttcactgcttgccagtcctttcccatcaccactgcccccagtcactgccattttctttttaactttcttgccaggaatgttctaacagtacccaagtagactccctgcttgctgtctgctcagtctatccttcacagatttatagcttattcttcctaaagctcaagaacccaccatggctccctgctccctgctatataaaaattcagactctcagatcaccattctaggtgtcctgaacactttctccaacctacctctagccttgtttcccactacctggtgtgtgtccaactaaactgtagttcctaaggagttttccaaactcctgtctctgttcctgttttctatgctgagggctccctttccaaatcactgctgtttcatttctcttgccctttttttttctttttttgagactgagtctcactctgtcacccaggctggagtgcagtggtgtgatctcggctcactgcaacctccacctccctggttcaagcaattcccctgcctcagcctcctgaatagctgggattacaggcacatgccaccatgcccggctaatttttttgtatttttaatagagatggggtttcaccatgttggccagactggtctcaaactcctgacctcaggcaatccacctacctcggcctctcgaagtgctggtattacaggcgtgagccaccacacccggcctcatttctctttatttttatgccatatctcaagtatctaggtgagatagccctatatgtcttctgtgagttcctccagacttgaatttgtgtgattttaagataccatattcttgcttacattgtcactaattatgtgtagatcttattcccttccaccatagtgtaagtccttggaacataatgacctcattttctttttttaaatttccagtagttcctaatgcaccatgtggtggagaggagtcactcagggtatcgaagggaagttaatgtttggtaaagccaaaacagaaaactgtgttcccactatggtggtggggaattcagtccccaggtcagaaaatcactgcctttggttccttcaagaaagtcctaggagtttttctccagcggcttcagaaggtggtggcggtaggtgcagaagcaaatgaagcttcgtcttctgctcagggcgtggtggctgtggataagatctatcttggatatcatctaacccacactctccagtgcagacacggagcatatggctcagggaggtagggagctggtccaagaccacagggctggttagtggtgaatctggaactatggtcctgcctggagttcagatcttctctgcccctaagttgggcctgcttgacttctggaggagcaaccctttctgccctcttctcagtatgacttttcatagtagaagaaaataaaacagtcacatctagaaggatgtagaatttaaaattcccaaaacacacaggaaaaaaagggttgaattttgttgactaaggtaggaaggactttctcggtgtcctctgatctgagggtatttgtattatgcctcagaattgataatgccatattttaactgacttcaatgataacttctcctttcaagaattaatattttgttgttgaattctcttgccatcacataagtgacaaaattactactagcaagtctttggtataaatggtgccacttaaagacatttgtgtcattacttcattgagttctttttttcctgcctataattttcatactcgttcatagaacagaaatgaacttttcatgtatagaaaaagatgagagtgaaaatgtcactgttaacctttggtgtaaaaataggattcccaattttgtatcctgttgcttatcctgatatagtagatccctgtccctggcctcactttgccactgctcctatagttatttgggatccaggattttggcaatacggcttcctgcatgaaaaaacaactccatattgttaaaagcaaacaaacagcttgcagagaaatggcctaccattgatgccatttcgatgtaataaaaaatactcaatgcataattggaatccaactttagaaacaaggtttaggtgggcagggtggctcatgtctgtaatcccagctacttgggaggctgaggtgggaggatcgcttgagcccaggggttcaaggctgcagctatgattgtgccattgcactccagcctgggtgacagagtgagaccctgtgttttaaaaaatgaaaaaaaaaatgcataggtgtgtgcatgatggcacaaacctgtggtcctagctgcttgggaggctgaggtggaaggattgcttagatgcaggagtttcaggctgcagtgaactatgattacaccactgtactccagacatcaaatcgtggtgatcttttgggagtaggattagaattgattttaaatttcttttgtgtacttcatgatgatttccctattttatatagtccctgaggcttttataataaaaatcctatgagcaaaaaaaaattaaaactccctagtgtaagttactgtgttgctattatgactttttttttttttttttttttttttggagacagattctcgctctgtcacccaggctggagtgcagtggcacgatcttggctcactgcaggttccacctcccgggttcaagctaattctcctgcctcagcctcccgagtagctgggattacaggcacacaccaccacacccagctaatttttgtagtttttttgcagagatggggtttcaccgttttggccaggctggccttaaactcctggcctcaagtggtccacgtgcctcggcctcccaaagtgctgggattacaggcatgagccacggtgcctggcctattaagacatttttaaagttactagagagctgcatgtggctgttggtaaaggtggtggtgggaggcgaggggaatgggcaacaacaaatttagagaaagaaaacttttcatgagaaagttggtttataccattatttaaacattttttgttgtaatataataatactttggtggttctgtaattataggtatcgcaaagggtttgaactccagtcatccctctattcgggaattaatcttgcagttttgctgattgttgctggacaacaatttgaaacttccttggaactaaggaaaataggtaaagctgcttattattgcagatgttgttgctttgattatacaagtttggcattaaaagttatgttgaaataactagcattatatcattatatttctattctttttttgagacagagtcttgctcggttgcccaggctggagtgtagtggtgtgatcttggctcactgcaacctccgcctcccgagttcaagcaattctcctgcctcagcctcctgagtagctgggattacaggtgcccaccaccacgcccagctaattttttttgtatttttagtagagatggggtttcaccatggtggacaggctggtctcgaactcttgacctcaagtgatccgcctacctcagcctcccaaagtgctgggattacaggcgtgagccaccgtgcccgtactactagaattatatttcaaaaggaacaatcagttacttttcctatagcacacctgagacagcagccaaaataaaatacctgcttatcctcagtatgacagaaactaaaaaagattattctgactatcaaaaattcaaattcttaaggtgtccggctgaacagtttgttgggaagaaaagggagcttggagaaaatgaacaattactgggatgtgggtcagttcttcagcgtcagcatgctggcccatgatgtcgggaaagccgtccaggcagcagagaggttgttcaaactgaaacctccagtctggtgagttgtgtctgtgtgttgtcatcacccatctcaatacatgatcttgttctgaaatgtcttccttataatcactatgtttctccttctgacttttcattaaagcaaagttagcacagacacaactgctctgagaattcccttgcttttatgtgaagggagggaaagacagatccacacagaatatatccctgcctgctccacccctgagattaggccttctattctattaatttctgcaggttgtctaggtcctcaagagaaaaacactcttggctactagtatgtattatgcatttgtgagaaagcatataataaaatgaaaaaagcacaccaagaaaatgtttatcacaaatgaaaactggaactaaaagaacaataatagggtatggtaaataaaacggtggcacagcaacagccttacacggccatttaaatgtgcaggaaagaatgtttggagatgtggaagtgtgttcgtggtttgttgtagagtaagaaaagccagtccccgggtaagtttttctgtatcagtggttctcaaattctgttgtgtgtcagaatcaacctatgttgattaaaacacagactgggtgtagtgacttatacctgtaatcctggcactctcggaggccgaggtgggaggattgcttgagcccagtagcttgagaccagactgggtaatagagtgagacccagtgtctacaaaaaaaaaaaaaaatagccaggcatggtggtgcacgcctgtggtcccagctactcgggaaggcagaggtagaaggatcgcttgagcctgggaggtcaaggctgcagcgagctgtgattgcacaactgcaatccagcctgggtgacagagtgagaccctgtctcaaaaataaataggtaaaataaagaaagaaaacacagattgctgggcccactctcagaatttctggcccagtaggtctggggtggacgcctgagaatttgcacttacaaattacaagctgctgctgctgctctggtgaccacactttgagaaccactgttctatatgatcttgttttaattaaaaatatgtgtttggcatgtgacttgtagggaaaggcccaggaggggtggacagtattggatttccccatagacatgaagctccgttagaattgtggtaacaaacctgcatgttgcacacatttaccctagaacttaaagcataaaaaaatatatatatatatgtatatatatgtgtgtatatatatgtgtatatatatgtgtgtatatatgtgtgtatatatatgtgtatatatatgtatatatatgtgtgtacatatatgtgtgtatatatgtgtgtgtgtgtgtgtatatatacatgatttgctggaaggactcacagaactcagaaaagctgttacactcttagttatggtttattacaatgaaaggatacagattaaaatcagcaaaggcagaaaggtacatagggtagagtccaggagagaccacgtgcaagcttccagttgtcctttcccagtggagtcatgtgaatagtgcttaattctcccagcaaaaatgtgtgacaacatgcatgaaatcttgccaaccagtaaagctcattgagccttaatgtccagggtttttattggggatgggtcatgtgggcatggagtcttcatgcagctgatattaatacctcagctccaacctctctagaggtcgaactgatacagtgtggcccagggccccgaagatgaatcatatcgttagcatagactatctgggatggcccaaggtcccagataaacagagatgctcttagctggcagtatatcccaagggcttagaggtgatctcccaatagccagtccagggccagatctttcttttgaatgtgtggagttgggacaacacaggcctgctgagtgcccaagcaagtcggttggagtctagctggcctatcttcccaggatagctccagcttttatccttaaagagcaaaataatactatgatgctttcagttgaaccattccgtttagtaccaaagaggttgtgaccaccactgcctggcaactatattccaaaaagttcagtttgcctgaaaagagcaaaggtgtggtcagagtcaagatgtcataacatcaaaatctacctagtcagattctaatatttcaaaaaataaaagacagtgagtttgactagtgattgccagaagtaagggagggggtgggatgggagggaggtaggcgtgatggtgggaaggcaacacaaggggtccctgtggggatggaaatttctctaacttgccttgtatcagtgacaacatcccggttgtgatacagtactatagttctttttttttcttttttttctttttttcttattatactttaagttttagggtacatgtgcacaacgtgcaggttacttacatatctatacatgtgccatgttggtgtgctgcacccattaactcatcatttaacattagatatatctcctaatgctaaccctcccccgcccccaccccataacaggccccggtgtgtggtgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcgtccttttttatggctgtatagtattccatggtgtatatgtgccacattttcttaattcagtctatcgttgttggacatttggcttggttccaagtgtttgctattgtgaatagtgccactataaacatacctgtgcatgagtctttatagcagcatgatttataatcctttgggtatatacccagtaatgggatggctgggtcaaatggtattactagttctagatgtctgaggaattgccacactgacttctacaatggttgaattagtttacagtcccaccaacagtgtaaaagtgttcctatttctccacatcctctccagcacctgttgtttcctgactttttaatgatcgccattctaactggtgtgagatggtatctcattgtagttttggtttgcatttttctgatggccagtgatgatcattttttcatgtgtcttttggctgcataaatgtctttttttgagaagtgtctgttcatattctttgcccactttttgatgggattgtttgtttttttcttgtaaatttgttggagtttattgtagattctggatattagccatttgtcagatgagtagattgcaaaaattttctcccattctgtaggttgcatgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgcataaggtgtaaggaagggatccagtttcagctttctccatatggctagccagttttcccagcaccatttattaaatagggactcctttccccattgcttgtttttgtcaggtttgtcacagatcagatagttgtagctatgcggcattatttctgagggctctgttctgttccattggtctatatctctgttttggtaccagtagcatgctgttttggttaccgtagccttgtagtatagtttgaagtcaggtagtgtgatgcctccagctttgttcttttggcttaggattgtcttggcaatgcaggctcttttttggttccatatgaactttaaagtagttttttccaattccatgaagaaagtcattggtagcttgatggggatggcattgaatctataaattaccttgggcagtatggccattttcacgatattgattcttcctacccaggagcatggaaagttcttccgtttccttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttagtggtgtataagaatgcttgtgatttttgcacattgattttgtatcctgagactttgctgaagttgcttatcagcttgagattttgggcgagacgatggggttttctagatatccaatcatgtcatctgcaaacagggacaatttgacttcctcttttcctaattgaataccctttatttccttctcctgcctgattaccctggccagaacttccaacactatgttgaataggagcggtgagagagggcatccctgtcttgtgccagttttcaaagggaatgcttccagtttttgcccattcagtatgatattggctgtgggtttgtcatagatacctcttattattttgagatacgtcccatcaatacctaatgtattgagagtttttagcatgaagcgttgttgaattttgtcaaaggccttttctgcatctattgagataatcatgtggtttttctctttggttctgtttatatgctggattacatttattgatttgcatgtgttgaaccagccttgcatcccagggatgaagcccacttgatcatggtggataagcttttgatatgctgctggattccgtttgccagtactttattgaggatttttgcattgatgttcatcaaggatattggtctaaaattctcttttttggttgtgtctctgccaggctttggtatcaggatgatgctggcctcataaaatgagttagggaggattccctctttttctattgattggaatagtttcagaaggaatggtaccagctcctcattgtacctctggtagaattcggctgtgaattcatctggtcctggactttttttggttggtaagctattattgcctcaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgcatctgtttgattcttctctcttttctttattagtcttgctagcagtctatcaattttgttgatcttttcaaaaaaccagctcctggattcattgatttttttgaagggttttttgtgtctctatttccttcagttctgctctgatcttagttatttcttgccttctgctagcttttgaatgtgtttgctcttgcttctctagttcttgtaattgtgatgttagggtgtcaattttggatcttcctgctttctcttgtgggcatttagtgctataaatttccctctacacactactttgaatgtgtcccagagattctggtatgttgtgtcttttttctcattggtttcaaagaacatctttatttctgccttcatttcgttatgtacccagtagtcattcaggagtaggttgttcagtttccatgtagttgagcggttttgagtgagtttcttaatcatgagtactagtttgattgcactgtggtctgagagagagtttgttataatttctgttctttcacatttgctaaggagtgctttacttccaactatgtggtcaattttgaaataagtgcagtgtggtgctgagaagaatgtatattctgttgatttggggtggagagttctgtagatgtctattaggtctgcttggtgcagagctgagttcaattcctggatatccttgttaactttctgtctcgtggatctgtctaatgttgacagtggggtgttaaagtctcccattattattgtgtgggagtctaagtctctttgtaggtctctaaggacttgctttatgaatgtgggtgttcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccgtttattttgagcctatgtgtgtctctgcacgtgagatgggtttcctgaatacagcacactgatgggtcttgactctttatccaatttgccagtctgtgtcttttaattggggcatttagcccatttatatttaaggttaaaattgttatgtgtgaatttgattctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgagaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgcagagagatcagctgttagtctgatgggcttccctttgtgggtaacctgacctctctctctggcttcccttaacattttttccttcatttcaactttggtgaatctgacaattatgtgtcttggagttgctcttctcgaggagtatctttgtggtgttctctgtatttcctgaatttgaatgttggcctgccttgctagtttggggaagttctcctagatactgtcctgcagagtgttttccagcttggttccattctctctgtcactttcaggtacaccaatcagatgtagatttggtcttttcacatagtcccatatttcttggtggctttgttcgtttatttttattctttttttctctaaacttctcacttcatttcattcatttgatcttccatcactgataccctttcttccagttgatcgaatcggctaccgaggcttgtgcattcatcacatagttcttgtgccttggttttcagctccatcaggtcctttaaggacttctctgcattggttattctagttagccgtttgtctaattttttttcaaggtttttaacttctttgccatgggttcgaacttcctcctttagctcggagtagtttgattgtctgaagtcttcttctcttaactcgtcaaagtcattctccgtccagctttgttccattgctggtgaggagctgcgttcctttggaggaggagaggtgctctgatttttagagtttccagtttttctgctctgtttcttccccatctttgtggttttatctacctttggtctttgatgaaggtgacgtacagatggggttttggtgtggatgtcctttctgtttgttagttttccttctaacactcaggaccctcagctgcaggtctgttggagtttgctggaggtccactccagaccctgtttgcctgggtatcagcagcagaggctgcagaacagcggatattggtgaacagcagatgttgttgcctgatcattcctctggaagttttgtctcagaggagtacccagccgtgtgaggtgtcagtctgcccctactggggggtgcctcccagttaggctacttgggggtcagggacccacttgaggaggcagtctgtccattctcagatctcgagctgcgtgctgggagaaccactactctcttcaaagctgtcagaccgggacatttaagtctgcagaggattctgatgccttttgtctggctgtgccctgcccccagaggtggagtctagagaggcaggcaggcctccttgagctgaggtgggctccacccagttcgagcttcccggaggctttgtttacctactcaagcctcggcagtggtgggcgcccctcccccagcctcactgccgccttgcagtttgatctcagactgctgtgctagcaatgagtgaggctctgggcgtaggaccctctgagccaggcgcgggatataatctcctggtgtgccatttgctaagaccattggaaaagcgcagtattagggtgggagcgacccgattttccaggtgccgtctgtcaccccttgctttgactaggaaagggaattccctgaccccttgtgcttcccgggtgaggcagtgcctcgccctgctttagctcacgcttggtgcgctgcaccccctgtcctgcacccactttccaacactccccagtgagatgtacctggtacctcagttggaaatgcagaaatcacccgtcttctgcatcgctcatgctgggggctgtcgactggagttgttcgtattcagccatcttggctctaccaaaaactgtactatagttttgtaagatgctaccattggagtaaacctggtcaaagatatatgggttctctctgtattggttcttagcacttcatgtaaatctaaaattacctcaaaataacatgtttaattaaaaagaaaatgagtttgaaattttgtcattttgtaattgctttgaactttgaactacagctgacccttgaacaatgtgggagttaggggctcagttgaaaattcaccaaaaacttaactacgaatagcctactgttgactggaagccttaccaataacataaacaatattttgtattttatattttgcaaaaagtgcaggattttcgcaaccactgacaactgcagtgacggcttcatgaatttccttttctgtttctcctacgatttttaggctggcttcatttatcttgaaatggcagcagccgtaactgcagaactcaatctgcaatacatatcaagcaattcaactttttctggtaatgtcatgacttttctcggcttcttgggagcatttccagtatcactagtggcactctctatgggtcccatggtgttattcattgtttatggtgtcacactaaatacaatgaagaatgcacgagaaccgtgagtgatcactttttactatgatctgcaatttactggagagacgaacttctcatgcaaaaatgatcagtctcacacggtggaagttttttttttttggttgtttgtttttgagacagagtctcgctctgttgcccaggctggagtgcagtggcacaatctcagctcactgcaacctccgtctctcagcttcaagcattccttctgcctcagcctcccaagtagttgggactatagacgcctgccaccgcatcctgctaatttttgtatttttagtagagacaggatttcaccatgttggccaggctggtcttggactcctgacctcaggtcatctgcccacctaggcctcccaaagtgctgggattacaggtgtgagccaccgcacctggccacatggtggagttttaagcagatacttacaacaggagctcaccacaatagcaacaggaggtggctatgaaattcttacagtagtgcagtatgcactacagttaattttatgcagttttgatataataccacatctttacatttgtttatatttttcttgactgggaatggtgccatatacagtctgtaagtgtgtgtgtaagttttggtacattttaactttttgtaagagatttgtatatatgttgggtagtaaatgataaaatggaccagtacctacatatattttatgtgttcatggcatacctagctttttctaatttttttttttatatttctaggcttcacagtttatctgcaaagtttttcaaattgtcgcacgtctccagaacattttccaatgtatctattgggaaaaaaaatccatgtataagtggagctgcgcagttcatacctgtgttgttcaagagtcagctgtgcctgcccttgttatttaaaacagttaccacatgctttccaatctccacattttaggcagtaggtactaaaattggggttagcacaatgttggtaaaaagccacgttgtgttattttgttggatggacttactttgcctactgctcgtgttttcttaattagttttgtggctgctgagcagtcgtttatgaagcactcatgacataatatgaatttaagtgaataaaagcttttggaaagcttcttttaaagggacttgaattgaattcagtttctttaggaatccaatatattgctgtttgtgatttttccaggtacctgcgatcattagttcagaacttgttactaattcggcgcttcaagaaaaccattattgaacactcgcccaggcaagagcggctgaacttctggttagatataatttttgaggcaacaaatgaagtcactaatggactcagatttccagtaagatatgctaaatccatttttttttaagattaggaaaaaaactagggattggtgctatttaactattgaatactctgaactgaagaaaactgtagagtaattttaaatgttgggataaacatcaatcttatgtgaaatcagtaagtgatagatcagctcactcatagatcattggccatatcctctatagtagtcattctcaattggaagcaactttgtccccctaaggtacatctggtaatgtccggagacatttttggtggtcatgacttggggagaaggtggcactactggcatctgctggatagagaccagggatgctgttgaacatcccacaatgcacaggacagccccctccaataaagaattatccagcccaaaatgtcactagtgccaaagtggacaaactttcctctaaaacaatgtagcaccacgagtggaaacttggaattcagcgtggtttcctgttaagctttggtttgcctctaaggccactaattgatatttaaaagttaccaaaaaggcaaaattgcttttagcttttccttgagtttttgttttaatgttatgaccgtcttagagtcatgagtgaaatatgtgaatgtcttggaaattgaacttcagataattgtgttccatatttatgcgttgagaatttgtgaacatgccatttccaagaatttcattaagcatctaataaaatattgtttgaaatgattatgataattattttgttgccggttaataatacattttaaaatctttttttagttatgaaatatttcaaacctactgaaaggtacaaaaaaataatggagcagacaaccgcgtaatctctaaccaggtttagtgatcttaaacatgttgttttatttgttttggagatttattccctctctccctcctcatctcacccctcctctttctcttcccctcctcttttttttttttttttctttttttgagacggagtctcgtgcagtggtgcaacctcggctcactgcaacctccgcctcctgggttcaagtgattctcctgcctcagcctcctgagtagctgggattacaggtgtataccaccacacccatctaatttttgtatttttagtagagacagggcttcaccacgttggccaggctggtctcgaactcctgacctcaagtgatccgcctgctttggcctcccaaagtgccctcctccttctctcccgattttcttcctttggcctccttcttctctccttttccccttttctctttttcgtccccttctgttctttctccccaccttttctctccccactctcctcctcctcaccctcttctccctctctcccctcccctcctctcttttaacaaagtaacaccttactgatgggctatcacctctttttttatctcctttcatcttccccacccccccccccaagagatggcatctcaatatgttgtccttgaactcctgggctcaagtgatcctccgacctcaacctcccaaagtgctgggattacaggcgtgagccactgtgcctggccctcagtgaggatatattgagtacggacctccccgcctcctcgctgggcagggtgcgctatgttttctacccatgtacgttaacaggcatctgttcttgtttcaggttctggtcatagagccaaccaaagtgtaccagccttcttatgtttccataaacaatgaagccgaggagagaacagtttctttatggcatgtctcacccacagaaatggtaaggaggaaaaatcacaagcaatttaatcagttttcaaataggagagtctagatggtagtatttgaaggaaaaggcacccatgtttaacttctgaattatgagaatatatgagagagtatcatcacagatgagagacagtaggtttttccattttgtgtgtgtgtgggcatgtgtgtgtgtgggcatgtggtgaggtgtgggggtgggggagtgtgtgtgtgtgtgtgtgtgtgtgtgtgtataaaaacattaaaacaaatacaggttggtttgtttttttatagttaaaccttagggaagtgggtagaggatacaggctggtgtgttgtttcacagctgtagtcccaacacttttggaggccaaggcaggcgggttgcttgagcccaggagttcaagaccagcctgggtgacacatcaaaaccccgtctctataaaaaataaatttaaaaaattagccgggtgtggtggtgcacacctgtagtcccaactacttgggaggctgaagtgggaggatcgcttgaacctgggaggtcgaggccacagtgagctatcattgcaccactgcactcgagcctgggcaacagtgagaccctgtctctagaaaaataaaatagtaatatatttttagaagcacttatactggctttcttgatattcctcaactattactggatcctgtggctttccagataaaactcagactcttttactaagtgttcaagtccctccctatataatcctgccccctcccttcctctttctcttcagccctcagtgccagtcaggctgtcctcttactcgcccctgagctgtccctgcgggagctcctgtctaccctttcatttccatccttgttccttttgggatttccttcttccgattatccaagtcctagcttttgcaaagtcatctttaaccactccttcattccttccgctgagtgtctgtaggctaccaattgcctgtatcatgcacagaagaacatcctaagaatgcccatacatgacttgtatgtttgtagctgtaggagctatggaacagttacccactcctgaacaaatgcctgttgattattacataaaatgtgttgtttacttaactagtaaatgttcctcccaaatcaagaagttctctaaagccaccgtggaatagacctgccattggggaagtctttggaaactcatgtggctaagctttctgtatatgtgcagcctcctgcaggtggctgtgggttagacaagactcttgagtctgccctggctcccatttctgtgcctgaatccaaaggccgactcctgctgtctgccactatcctctctgcatgactttggactcatgtctcctctgaagtacacttagcctttctatgcagttggatgtgatttgctggctttcatattctcctaccctcttatgagaagcctccagtggcttcctgtctcacgcagagtcaaagctgacatcccgagggtggcctagaagtcctgcatgatttgcccatgagctctccaacctcctcttctactcccatcccgctcactccactgtagccatatttgcctctttgttggtccccgaacgtgccaggcacacccctcctcagggcctttgcacttgctgttccctctgcctggaactcttcccccaggcatccacgtggcttccttcttcccccactttagctttctgttcagaagtcatcagcgacgcctaccctgaacatcctgttgaacaacgtgaccccctgccctatcttaatgcccttccctactttatttgtcttcataacacttttcaccgccccccatggtatgattttactatttaatctattgtccatctctcttcactcacatgcaaggcccatgagggcaggaactttgtggttctctgctgtgtcttcagtattagtactttgcctagcacatacatagtaggtgcttgatcaacacgtatgactaaaacttctcccatcggaaaccatcttcccagtctgttcctgttgtcattgctccaggatggcaagaaactagtcatgtgcctattcatggcagttctcttgagccaaatgctcagtcacatggttctcatacttttcttccctgggtggcttagttggtcacttgtgacattcctcaggccaaccaaatggaatttttttttttttttgaggcagggtctcattctgtcacctaggctggagtgcagtggagtgattttggctcactggaacctctgcctcccaggttcaactgattgtcccatctcagcctcctgagttgctgggactacaggcgtgtgctaccatgctcagctcatttttgtatttttagtagagacggggtttcagcatgttggccaggctgatctcgaactcctgacctcaagtgatcgcccccacacctcggcctcccagagcgctgggattacaggtgtaagccaccacgcctggcccaaatggattttcctacttaaaattattttctgcaattgtgatgtattgatgttattgcctatggattttccaaaactggagtttcagatgttccttctcaggcttagctttgtgcaaagtgtagtggtagtgaagggaggggaccgagttagtttttgtttgtaagtgcaacttgggtgctgtttgaaatcccagttagtttttttattagtcatggtaggctagcttctaaaacaaacagcccccaaatctcaatatcttaacatgataaaagtttatctatgcctcatgtcatatccaggttgcagagggtggcggtggggggcattccatcttgcagtggatggggaaagaggaaatagagggttgctgtggagtttttgagtcaggcctgcaggtgatgcacagcattcctgctcacatcccattggccaaaactccactgtatatctctctagctgcaagggaggctgggaattgtagttcagctctatgttcagggagaaaaggaagactgatgaatgctgaaaggtgtctgtcgcagtcttgcctctcccaacatttttgcaagtcactcaacttaggtgggctagtcccatgcttgttttagagtttgcctactatgttgacagaagatgaaaagccactcactgtgtgtttattctatgcttattatttctatctgaaacttagattatttcaaatttacatcatttaaactggattagagatacaaatgaatttttataatacataagaaaatgtttctggtgttccatgttatacaaggtgtattgctgtaacccgtaaaaaaatcaccactgcaggtaaaatagcagaaatgattgaccatagaatgaaacaaaaaaaatcatttgctttaaaaaactcaaactattgacttctgtctttgataacttgcagaaacagatgcacgaatggaattttacagcctcttccataaagggaataaggtaagaacataggagaaaatggagttactattttaatgcaaatgatgataatgttttatgcactttaatgtttccacttactcataatatggaatgttcttatttttaatggaatccaaagtggactctctattatgttgtccttcctgagctagttattaatactagtgtactcctagtgagaacttcttgggttattataatagagtagctttgctcatattcagcagactaaactcacttgtgccattttttttaaagaagtgatcggtaggaagagaagatgtatcttttttgagccaaagatgttcaagtgctcagtgactctgagaactgaagccaggagatgattagtggcaacactcgggttggggtcttgtgaacagagtaatggagctgggagatttttttcagggagggcatgaggtggtgtattctcgggagaggagtagctcttgcattttggttcaggagtgatgacagtttgagcctgagctgtgtggccttacccaagcagggctaaacatctcagctgcacttgtcaccctggcagctcattcgagggtgagactggctgtgaagtagatgtgagttctaatctctctttgctgggtgatgttaggaaagtcactcagcttctctaagtctcagtttcttccctattttcttcaaataaagggcttgtactagaacattcctttctctgactctgaggctacctcagccactgaatgaatccccagttacttctagacatagtgtgatcctgtcctggaaacatcagtattgaaattaggataccatcaacatcacttaaaaggagggaaataatttaagtacaaagtagtgcattgggatgatactgcccaggaaatacaaggcaatttgaaatacactcagcaaagcatacacaaagcagcagaaaagggaataaaatatggtctctgtcctcaaggagtttatagtctcatgaaaaggaaaggtaaggtatttgagaaataatttattgtggtattacaagaatttctagactcggaaaatatcaggacacagtatttgtggccacacgagggaaatggaaataaacacggcactgtagctcaagaaaggcctttctttaaatgttatctggtccatctccacccagtgtgtgtacctgactctacagctcatccagcaagcaatattcagcttgcctgagcatagctagtgacagaaaatctgctagtaaaatatgtatttttattttttaaattattttattttattttatttttttgtcttgctctgtcacccaggctggagtacagtggcacgatctcggctcactgcaacctctgcctcccaggttcaagcgattctcctgcctcagcctccagagtagctgggactacaggtgtgtggcacaatgcctggctgatttttgtattttttgtagagtcagggttttgccatgttggtcaggctggtctcgaactcctgacctcaagtgatccgcccgcgtcagcctcccaaaatgctaggattacaggcatgagccactgtgccttgtgaagattttcaaaaatgtgttacttagtaattaagttgtgttagagcaggtagtcaagatccttctgtttgtgcctcctcatagagatacctctaggtgccatttcagccatcagtggggatttacaaagggcctgagggcgtatcatcctcgccccacccctccccgggacccatgtgacctgaagagtatactttgagcgttccagaggctctccaactaactgtggtggttgctttacagattgattttcaaaacctgctcacttataatctagttctaattctttttgaatctcctctgtactcttggtgttccaacccagtgtttgtcatgcaatctataacataaagaatggtctaggacagtttggatctcagcaagagataacttagaaaggatgagataaagtggcttcagttgtttgaagggacaatgatagaagagaatctagccttcctctccataatacctcctggcatgagggccactgctctctgacatacaatctactagcagatttcctgtcactggctatgtccaggcaagctgaatattgcttgttggatgagctgtagaatcaggtacagaccctgggtggagatggaccagataacaaacatttaaaggcctttcttgagctacagtgccatgtttatttccatttcccttgtgtggccacaaatactgtgtcctgatactttccgaatctagaaattcccttaataccacaataaattatttcacaaataccttgcctttctttttcatgagattataagccccttgaggacagagaaccatattttattcccctttctgttgcccgtatgctttgcttagcactgaattatattaagagtaagttcatattaaggtcagttgataaatacaaactcaaatataagcaagataaatgtctctggtatttaaatttcatagagaaataaaaggcagactcggggggtgtttgtttaaaacattaatgaatctttcaggaattgataaaatagaagaaaagattgtcttgcagatttagagtgggtatcataacttatgtataaacattatgctttgaaattttacagcctatcaaagtttgatgaaaggtgttgttttctttatgtccatgataattctgatgactttcaaatctacttttccaccgaagagcagtgcagtaggtgagttacagccaattcaggtatttgcaatgtaattatggcgaatcatttttaaagggcctttgttctgaaagatatttacttgctattactgtctttcttgaaatgttaacttacatctcaaaaaagctctaaaatttctgtaattcacatagcaggtaattcagccatttaaaatacacaacttggccaggtgcagtagctcacgcctgtaatctcagcactttgggaggctgaggagggtggatcacctgaggttaggagtttgagaccagcctgaccaacatggagaaaccctgcctctactaaaaatacaaaattagccgggtgtggtggcgcatgcctgtaatcccagctacttgagaggctgaggcaggagaatcacttgaacccgggaagtggaggttgcagtgagctgagattgtgccattgcaccccagcctggggaacaagagcgaaactccacttcaaaaaaataaataacataacattcagcattttttagtatagtcatagttttccaaccaacaccataatctagttttagaatattttcgtcacccccacaagaaacacactatccatagagtcattcctcattccctcaacctcgccccatcttggccccagccctaggtaaccattaatctttgtgtctctatggctctgcctattctggccatttcatataagtggaatcatacagtatgtggtctcttgtgactggcttctttcacttagcgtaatttttttaaggtttatccatgtgtaacacgtatcagtacttcatttctttttgtggctgaatgatattcttttgtatggctataccacagtttatctgtttttcagccaataggcatttggattgtttgcactttttgacaattatgaattgtacttccctgaacattcacgtgcaagtatttgtgaggacatgtttttatttctcttggagtcaaattgctgggtcttatggtaactctacgtttaaccttttgaggaactgccagaccattttcccattttatattcccattagcaatgtatgtggcttccaatttctccacgtccttgccaacactagttattatctgtcttttgagtattgtaatcctagtggatgtgaggtgggatctcattgtggttttgattcgcattttcctgacgactaatgatactgagcatcatttcatgtgcttattggccatttatatacctctggagaaatgtctattcaaattcttagtccaattaaaaaaattaaactttttatttttgaaaatatttacagccataggaaagtttcaaaatacaatacaaagaatttccatatacgtttcacacagaatttctcagggtttaccccttaccacattggttttacattctcgctctatgcatatggttattttttctgaactgtttaaaagtaagttgtagacaatgctccattacctgtaaatacttgagtgtatttcgtaaaaacaaggatactgacttgtgtaattacagtacagttatctaatgaggaaattaagatagatatagtactataatctacaacatttatccaaattttacttagtgtcccaatgatgtcttttatagcaaaacaaaaggtttttcctctggtccacgttccaatccaggatcacatgttgcattgagttgtcacgtctgcatagtctcctttcacctgaaagagttcatcatcagtctttgtcttttttgacttaatactttccaagagtacagacagtttattttgggtagtcctttgacttggatttgtttatcgtttcctcatgagtacactgatgttatgtatttggcaggaatatcacagaaatgatgttgtgtccttctcagtgcctcataacaagggacacaatatttctgtgtcatcattggtgatgttaacgtggatcatctggtgaaagtggtgtttgccagctatctccaaactttgcccacttataattgggttatttatcattttattattgattttaagagtgatatatacatatatatgtgatatattttttctctatgtaagttctttatcagatatgatttgcaaatgctttttcccatcctgtaggttgtcttttcactctctcgatggtatcacttgcagcacgaaagtttttaatttggatgaagtacaacttacctatttatttcttttgtcatttgtgcctttggctcttgtcttagaagctttgtctagcctgaggtgttctatggtttttatgttttcttccaagagttttatagttttaacttttatatgtttaggtttttgacccattttgaattcatttttggatgtggtgtaaggtaggggttccaactttattctttaacgtggatatgtggttgtcctagcaccatttgttgaaaagactattcttgaaaagactattctttccctgattgagtggtcttggtactctttttggaaatcagttgaccacaaatgtaggagtttatttctggactctcaattccgttccattgttttgtatgtctattcttaatgcaagcaccatgctttctctattactgtagctttgtagtaagttgtaaaatcaggaaatgtgagccctccaacttcgttcttgtttttcaagattgttttggttattgtggatgcttgcatttccacgtaaatattaggatcagcttatcaatttctgtagaaaaatggcagctaggactttgacagggaatacgttggatatctagatcaatttggagagcattgccatattaaccatcctggcttccaatccatgaacacaagatggatttctatttacttaggttttcttgaatttctttcaatgatagttttgtagtttcagtgtacaaattttgtacttcttttattaagtacatacctaaggattttattattttgatactggagtttttttaatttcacttttggatgttcactgataatgtattagaaatacacttgagttgtaaatgttgattttgtaacttacaaccttgctgaactcatgtattagctctaatgggttttattgaattccttagggttttctatgtgcaatatcatgtcatctgcagatacagttttagtttttcctttccaacctagatgcctttattttccttgcctaattatcctagctagactctccagcacaatgtggaatagaaatagggagagtagacatctttattttgttcctgtttttaagaagaaagaagttagtctttcatcattaagtatgatgttagcagcagatttttcatagataacctttatcagattgaggaagttccctttattcatagttcatttgtatcatgtaatttgagaaagtcttaattcattgtgtctcagacaatcattgtcacaacatatttaaagattaggctaggctgggtgtggtggctgatgcctgtaatcctagcactttgggaggctgaggaaggaggattgcttgagtgggcagttcgagaccagcctgggcgacatggtaaaaccccgtctctgcaaaaagtacaaaaaaaaaaaaaattagctcagcatggtgacatacacctgtagtcccagctactcaggaggcagaagtgggaggatcacctgagcctgggaggttgaggctgtggtgagtggtgatcatgccactgcactccagcctgggcgacagagcaagatcctgtcaaaaaaaaaaaaaaaaaagaatagaataaatagcagactagggaatcattggatcataaccttcaatttacagtagaaaaaatgctgccaaatataaattggtgtaaaagtaattgcagtttttgccattaaaaacctaatattaagcagaacatccttttactactacaaaatgtgcccttttgaccctcattcagtactcagtgcctttttttaaaaatacattttaataatttttttattgatgtgtaacgtataaacaagtttgtaatgtgcacttaagtgtacagcttgataaattttgatacatatatacattcttgtacctgcctcccagatcagcaccccagaagttgctttgtgccccttcacagtcattaaactccctccagtgataactgttttgatttttaccaccaatggttagtttcacctgttcttgacctacaaataaacagaatcatgtagtttgtacccttgtttctcacctctttcccttaaaataatattcatagctgggcacggtggcccacacctgtaatcccagcactttgggaggccaaggcaggaggatcggttgatcccaggagttcaagaccagcctgggcaacacagggagaccctcgtctctacaaaaaataaaaaaattagctgggcgtggtggtgtgcgcctccagtcccagctacttgggaggatgaggtgggaggattgcttgagcctgtgaggtcgagactgcagtgaaccatgatcacgccactgcactccaggctaggtgacagagtgataccccatctcaaaaacaagaaacaaaatgaaatccaactgtgaagtatatatcagttcattctttctctgtgtagcattccgttgtgttccaatttatctgttcttctattaatgaagacttggattgtttctgtttgggggttattatgaagaaaatgactatgaacattcttatatatgccttttggtgaacatatatattgatttctattgagtatatatctaggagtggattactggattatagggtaggtttatcttcagctttggttgttgatactgccaagagttttccaaagtggtcatgtcaatttacactcccactagcaatgtatgagagtcccagttgttccgtattcttaagaacagttgatatcatcttttattttttttctgttgagacagagtcttgctcttttgcccagctggagtgcagtggcgcagtcttggctcactgcaacctctgcctcccggtctcaagcaatcttcctacctcagtctcctgagtagctgggactacaggtgtgtgccaccacacctggctaatttaaaaaaaaaaaaaaattgtagaaacggggtttcggccacgttgcccaggttggtctcgaactcctggcctcaagcagtcttcccgcttcagtctcccaaagtgctaagattacaggcatgagccactacacctggctgataccgtcttttaaatcttagttgttctgtgagtgcataccatatgtctcttaagaagcctgacgattgggttatccagctttcaaagattagaagaaaaggtaagatgggttagttagaaaaaagagcattttaatggtttatggaaattatcctgaaatgtacagtattcctccttgacatcttaagagagaattgtgagtaaaaatgttctaatgagtcaagatgacttgtatccaaataaaaactgcacaagtctaggaagtggcccacgtggcccagtagaatttgtgagaaagatttatgggtcaatattaagcttgttctgtgtcagcagaatgatgtggccaccttatgcgtttcctcctcaccattccccttatacaacaccctgtatcttactgagaactagattgtctgtactttgagaggcaatagtccccctatccttagcattgattagatcccctctgaacactggtcttggggccagacttcaagaataatacaagaggctgggtgcgggggctcatgcctcccaacactttcggaggccgtggtgggagaatcatttgagtccaggagtttgagaccaagctgggcaacatagtgagaccccgtctacaaaaaatacaaaaattagccgggcttggtgatgggtgcctgtagtctcagctgcttgagaggctgaggtgggaggattgcttgagctcaggaggctggctgaggctgcattgagctgtgatcacatcactgcactccagcctgggcgacagagcgagaccctgtctttaaaaaaaaaaagaaaaagagtaacacagggacgtcatctgaagaattacctgctagtagagtaactcacacgtcctggggaaaacagtgatgggacagaaaggaaagacttatagggacatggtaaaattatgtgcacttctaatggggtgttaagtagaaaaatggttaattctaagcaaactgtggatggaacccacatgaaagaagtctttggttcagtaaaagggaaatatttctcattaagatcttccaagaatgagctgtctttgggaggtaatgagttctctgttgctggaggtactcaagcatcaattggtcaaccagttggtggagatactatacagaggggattcaggtatcacattggtagttgccctagatttgataaccactaaagtaccacgtcaaatcaaggaggggatcgattgttccatgacttgtaaaagtttggtttatatttaagtacagtttaataaagctaagttaaaaacaaggaatgagagcagttctgagttggcaacgtatttgtgacacttgctgttctagatttttctctttggtcaaagagatgataaccaatacagcaggcagtacggtggagctggagggagagaccgatggagacaccttggaggtgagtcatggacgatctagaatatggaaaacattgattgtgtgttcgatgcttcaagaaaatgtcccatctttctataaaaatcctctgttgagtatgttttatgaacctgccagccatcactgcatggttcccagagataatgttgaatgtgtctccagagaagaatctcatttctttgggattctctcagttagaatgcttaagaaaaatttggccatggactagactaaaatttccttttgtgaacaacctatgaaagttttctctaggctaattagtaatgtctgtgagactacaagagaattagttggccaactgagagcagacgttttatgcttaaaatgactttagttatagctatgtgcatatactatatgaaatataacaactttaaaatcattttaaaaagtaggctcatcagctctttttaacagcacagttatagtccacagttgctaaaccattgtacaggtgtttaaatcttgcccagttattcagatttgccactcactcaggttcttccagtgattacaatttaatgagattttactgtactttcaggttagactgaaaggaattccttaatgtttctttcagaaaatatcaaagggattcattttaataattgagttaactactagaattcttaggtcaggaccagagtttgttgtagaaatgaactgagcaatggtgctttgagggcagcaggtgtgggaatcggagggaggtgtgaggtaaaagtcttctatggagcaggctgattgccagttacatcagacactgatggagatcctttactaaccatgtttttttttttttttttttttttttttggaaacagagtctcacgctgttgctgaggctggagtggagtgcagtggcgcaatctcgccttactgcaacctctgcctcctgggttcaagcgattctcctgcctcagcctcccatgtagctgggactacaggcacccgccaccacgcctggctaatttttgtattttatttatttagagatggagtcttcctctgttacccaggctggagtgcagtggcgtgatcttggctcactgcaacctccacctaccaggtttaagcgattctcctgcctcagcatcctgagtagctgggaccacaggcacgtgccaccacgcctggctaattttttgtatttttagtagaaacgggatttcaccatgttggccaggctggtctcgaattcctgacctcaggtggtctactcgcctcggcctcccaaagtgctgggattacaggcatgagccaccacgcctggcctaatttttgtatttttagtagagatggggtttcgctatgttggccatgctggtctcaggtggtcctcctgcctgggcctcccaaagtgctaggattacaagcatgagccacagtgtccagccaaccctttagtaatcttaattgtcatgaacatccctagaagtagatgggaaaggacacccacatacccgccgactattccgtgtataagctgcacttctgtaagtagaagcagtggagcatgcaaaataacagaaaaaattgattgctgcctctctgctttaaataagtgttgctcagcgtacagtcacatttgttttaatcatcgagaagaatcaaatgcatctgtatgtgacagcttttgatgggaagatgggggaacaaaatagtaatgctaattgtaaatcaagtttttgtactaggtgtttactactagatccgtatgcctgaaagagtggggaagccccagcatatttactttttgtattaagataatgttaattatattgaccttcaattcctttctgggttattgaaagatatttgtttcctgacaacttgataagggattatgcaggaagacacctagttgggttattcaacatgcttagaagcagttttaaattgcagcgttaaaatggggaagaatttccaaaaggtgagccaattatatgcaaaccatatttttaattttcttggattccatttcataaagtcatactatgaacaggtgaacaatggagaattctgcccctttaaagtcatttaatgaaaagggcctaagctaagcactgtgacttgcctgacagtcaaataatgttatttatattttttttagttgctagacaactctgggggccttagagggcttctccgctacaagttgtatgcttttttgtccttttgtttttccttcttcagtatgagtatgaccatgatgcaaatggtgagagagttgtcttggggaaaggcacgtatgggattgtgtatgctggccgagatctgagcaatcaagtgcgaatagccatcaaagaaatcccggagagagatagcaggcaagtccaggcgggccttccgcatttcgggtgccgtctccacaccccagatcccatacccaccgctcatggtgtggaggagttaagggcaaaagcattgtgttaccacaaaacctgtcattctcttgtaataggggtgatcttttttttttttttttttttgaaacggagtctcgctctattgcccaggctggagtgcagtggcatgatcttggctcactgcaacctctgcctcccaggttcaagcaattctcatggctcaacctgtagctgggattacaccatgcccagctgatttttttgtatttttagtagagacggggtttcaccatgttggtcaggttggtctcgaactcctgacctcaagtgatctgcccgccttggcctcccaaagtgctgggattacaggcatgagccaccgcgcccggccagggtgatgtgcttttgttttgtgtattatagattgagaaaatggaagaactacacttcagaggcacgtggattgcagaggatcatattttaaaagaaaacttttgttgtgtttccacccattggctaggtctaaagttttacattttttgcgtagttgtttgcaaatatatatacatttttgagatgaagtctcactctgtcactcaggcaggagtgcagtggcagatctcggctcactgcagtctccacctcctgggctcaagtgatcttcccacttcagccgcctgaggagctgggactacagacacacgtcaccatgcctgtctaatttttgagtgcaaatataatttttaaatattactgggttattttaaatttacattgtagcagttgaaaatggctatgatttgttcagatgcatcattgtggaaaattacatgcagataaaaaaaatcagatttttgcagtacagaattttttttaacatcctacccttcaccctcacacatggattttggactgtttttctaccatgagtactgcttattcatttctttgactttttttaattttaagaaatgtttgtttctagccgggcattgtagctcaagcctgtaatcccagcactttgggaggctgaggcgggcagctcacttgaggtcaagagttcaagaccagcctggggaacatggtgaaacctcgtctctgttaaaaatacaaaacttaggtgggtgggcatggtggcgcacacctgtagtcccagctactctggaggctgaggcacgagaatcgcttgaaccccggaggcagaggctacagtgagccgagactgtgccactgcactccagcctgggtgacagagtgagaccctgtctcaaaaaaaaaaaaaaaagtttaaatttataccccaacaaaatgagcattgcaatgttgactgcaaagtgtttctgtagagaagctacatacacagttggaattaatcattccgggatccacaggtgtgtcagaccacagctgtaggattgccttcagtgtcgagtgctgaagaataatgtgtaaacacccatgtatctgggtgattgctgatatattggggatgagttttaagggatttctgccagctgtaagacccttcattcatccattcatgtatttgttgattttcagtgggatagcatgttatgatacgtgaattatgagacaggacctgaaatgaactatttccatttcttcatttcaccaataagaaaatcaagactgaggaagattaaatgactttcccaaggatgcttagaaacaagactaggatccgagtctcttgagttcctcatccagcatccagtctcttttctcatgatggataaggtgttgcagttgtatctatttggggaaatttctggcatgtcccatctccttcatttggtagcaatagctgttctagctttttgttgctgatcagtagttcctgggattttaagagctagaagggacctttagagactgttttgttcaactccctaaatttataggctgaacttatgatgataggtactttctctgtgtcagactctgggctggcactggggaccgaaaggtgattaggatagtgtccttttcccagggttctgctggttcggtggcaaatgcagatgctttgcctctgagtgaaagtgccaagtgccatgatagaggagtacacagagtgtttttagaacgcagaagaggaatgaattactctccttagtgagttgtggcaagtttgaaaaaatagatcaactttgagctgcactttgagggatgagtaagaatttgtttagcggaaaaggaggcctatgctgatggaaaaacagagctgttaaaacacaaagtatattcagagaacaacagattgtctgatatgacttgaatgtaggatgcagggcagtgagatgctcttgaaatgaggccaaaaaaaaattttttaaggcttagcctgaactgatctttgaaagtccttgtatgtgacattaaatagcatggtctctatgtggaatttatgtggggaagggatgtggtgaagtgtgtgttttaagaagaggtagtataatggccaaggttggggaatggattaaaaaggccagaggctggggctgggtggcccattaggtggctgctgttgtggtctggggcgactctgtagaataagacgagagggcagctgagggcagaaccttccagaacaccactcttcatgggaggcagaggaagaggggctgttgagagaggtaaagaatggttggtgggttcaggcccgaaaaataacagtagtaacaatagcagtcattcattgaatactcaccacacaccagctactccactaagtgcttaatgaaatggacatgccttggcccctggcagccctgcatggctgtaggcttatcctctattgtacagatgggaagttgaatagtttcatggaagccagagaaaagaaagtttccagaaagaagggatgggcagcagtggggcaggtcctggtgaggtgagatgtggttctagagtccctgggatttggcaggtgaccctggctctgtttttcccaataggtattctcagcctctgcacgaggagatagccctgcacaagtaccttaagcaccgcaatatcgttcagtacctgggctctgtttcagagaacggctacattaagatatttatggagcaggtgcctggaggtgagtagtcgctgtcttctggtctcacattctgaaaatcactacgacgtggatgtcatttgttgtcctgccatttacaaaatgacagacccctaagccaggcctgtagggcgcctgtagtcccagttacttgggaggccgagatgggaagatcacttgagcccatgaggtcaaggctgcagtgagccatgatcacagcactgcactccagcctgggcgacagagcaaaacccatcactctttttaaaaaaaaaaaaaaaaaaaaaaaaaaaaaaaaaaaaaaaaaaaaaagcaacagaccctttagatgttggaaagttggatactttccaaatgtcatataagcagtctatttctggtttgttgatgcagtttgttcaacccacaaatattcattgactgtctatggagaaaacatagtctttggccttgaggccttcacagtctaggagtttaaaggtgggtttggacaagggtgcagaagagggaacatagatgttaaaagtgacagtgcaaaatagcattttgataatgaaatcaagcatcagtgttttatccacaaaaatccctgaatgcaagagatagggcacaggaggggagttcctgggatctggacccagaccatctagtctgagtccgttcctccatccacaagctgtgtgacttcaggcaaattgttatacctctctgtgccctcagttttctgattgaataaatgaactgtaaaattggagtaataatgactctgataattggagtaataattattggagtaacaattaacgctgtctcagtgggctgttgggtggattctgtctggcagagaacaagagctcagtaagtgctcattgaaataatgaatcaaactctttaattaaataatagttatctgaatacagatgttaaaacttcagttagaaatcttcattcattcattcaactgacagttattaagagtctgctattacaggaagagtcttaagtatatttattaagagccaggcagtcagccaggcacagtggtcacgcctgtaatcccagcactttgggaggccaaggcaggtggatcacttgaggccaggaattcgagaccagcctggccaacatggagaaaccccctctctactaaaaatacaaaaaattagccaggtgtggtggcgtgcgcctgtagtcccagctactccggaggctgaggcacaagaatcgcttaaaaccaggaggaggaggttgcagtgagccaagatcataccactccactccattctaggttacacagtgagactccgtcttcaaaaaaaaaaaaaaaaaaaaaaaaaaaaagagccaggcagtgggctagattttcagggttatgttagaataaataaagtagtttgtctttcccttaagttggtcatagtctatcagaaaactcgtccattgctgctttttctttttttttttgagatggagtctctctgtctgttgcccaggctggagtgcagtggtacgatattggctcactgatggcaacctctgcctcctgggttcaagcaattctctctgcctcagcctctcaagtagctaggattacaagtgcgtgccaccacgcctggctaatttttgtatttttagtagagatggggttttgccacgttgaccaggctggtcttgaactcctgacctcaggtgatctgcccgcctcggcctcccaaagtgctgggattacaggcgtgagccaccgtgcccggccccttactcttcacgttagttgataaccccatccccggcgttaggtttaagggtatcaacagaaatagagacagatgtgttcatccccttttatagatggggaaaccaaggtagatcaaggtcccataacactgtgtaagtgggaatctgagaccagccgatgtctgagggcccgttcctgccaatggacaggacatcccgcagttcacatgatgtccttcgagacgtggtcacagtgtccttaagggagcttttcttttggcccaaatgttcagtgtttaatagcgtaattgggggaagtggttgttgatcaagacagtcctgccctgagacttgccactgtggctttctcacattgaggacagagagacccaacttcctccagtcctagtccttgtcaccctaaagggcccctcactgtggacctgtccacctctgattacagacaaggtataaaacgtggctttaacccaagcagaatgactgagacagacctgctgtaaacaagtgtcatgggacctgagttatctacgccagcaggccatgcccctcaagttgagagagcattatttcgctctcctcctaacttcatgtagctgaacagagctaaacccacaattggccccactgaatttcagggggcacaaggggttcatgttcaccctgtgcctctggttaggttcatgtgctcaattgcttccagtccattccctggctgtagctacagaggggaggaaacatgttgcatttagcccagatccgatggtgttggtgtaagcacttaggttaggttagaaacctcacctcactttatttccctgaacttttattgaaactttctcttcctgataagttttttgctgtgactgtctctaggaagcctttctgctcttctgcgatccaaatgggggccgatgaaggaaccgacaatcaagttttacaccaaacagatcctggagggccttaagtatcttcatgaaaaccagatcgtgcacagagacataaaggtacttgcttttttaagctgacgaggttgcctttgctcgtatcagatcatgagagctgtcgatggtgtctgctgagtgactggctgacagaggggtatgatttagcacaaccgtccccaaaatgcaaagtctagttttcctagagacttgtgacggtttcccaaggtccagatctgtttcatatgagttcgtttcagcctgtcttttaagcacttgatgatgttattttccgaagggcgataatgttctggtgaacacctacagcggagtggtgaaaatctccgattttggaacctcgaaacgtcttgcgggtgtgaacccctgcacagagacttttactggtaagtggaccaaagcttggcacagggtgcccatcccagagttacgctttctgcacaagctgcggttgttcagccgttacttagtgagcaccttttctgagcagagtgagcaattgatacttgaagtagacagtggattgtccccaacttcaaattgttttaactttgtcatagtgatgcacctagccagctacttgtggcaacaagattgccctactttcttctttgtcatccaaaagttgggtagatggagtgctctgctgaggttctgaggttttcttttcttttttttctttttttctttcttttttttttttttttttttttgagacggggtctcactctgtcgcctaggctggagtgcagtggcacgatctcggctcactgctacctccacctcctgggttcaaatgattctcgtctctcagcctcccaagtagcttggattataggcgcgccccctaccacacctaattttctattttcagtagagacgaggtttcaccatgttgaccaggctggtctcgaactcctgacctcaagtgattcgcccacctcagcctcccaaagtgctgggatagattacagatgtgagccaccgcgcctggcctctgctgaggctttctgaaggtcactcaaccaatcagcaagatggcagcacatctctttaaagttaatagcacattatctgaaatcgtgggtaatgctgaataacagtattcctcagacaactgattaagacattttattggtctgtcataaaaatagcctgttactgtagtgaattctggtaccttgtgttttgatatgattgtgtttccaagagaggctaattcttcctggggaatatggtattctaagtgattttgaggaattggattttcttgtccatgtgtcagtaatggaataacttgagcattgagagggactgggttcaaagggtggtatacaattaccagctagtttcacagttgtaagatcaataagtagaatgatggtcaaaagctacttgtggctattggaaattcctgcttaaacctgactaataacaagaactttgatccttggaaagaagtactgatttttgaataagtaaaggtttatagtcccccaaggagtaacgtaaagatcacaaagatcttgcttgatggaattatgaaacagctggggcctggtatagtggctgacacctgtaatcccagcactttaaaaggccaagatgggaggatcacttgaggccagcagtgcaagaccagcgtggtcaacatagtgagaccccatttcttaaaagaaaaaaaaaaaaacagctttcataggctgggcactttgggagattgaggcaggaggatctcacttgagctcaggagttcaagaccagcctgcgcaacatagggagaaccccatctctacaaaaaataaataattattattattacatattatatttatatattatatgttatatataatataatacataatgattatatataatatatgtatataacatatattatatagtaattattagctgggtgtggtggtgtgcgcctatggtcccagctactagtgaggctgaggtgggaggatcgcttgagcccaggaggttgaggctgcagtgagctgtgattgtgccactgcactccagcctgggtggcagagtgagactctgtctcaaaaaaaaaaaaaaaaaaaaaagaaaaaattagctcttaaaataatatagctctgaaataagctataaaagacaggtgactgttctctatctctgcagtcaccaaagctgtagggtggacagcttgggtcttatttttggtaaataatgtgtcagctttgaaagactttttgtcaatgagagagttgtcgcgtgtcagccactggacacccacagtggagacacattcaccatctaaagagaattttaatacatcacaaaatgacttctcacttgtaacacaaggggaggtacatgtgcctgaaaatgggaaaatactataccagggacactatcagaatctcccaaagaaagagtgcattgaattttcattcattgtttctggtataaatatacgtatacatctgtcaatgtgtgtatatgaatatgtgtgtatgactagcacttcattttcttttagcattttactaccctaattgaaaatgacttgtatcctcctctttggaagccaccaattagcttggcaatacatagcaagaggggctctgatatgacaaggagttatttgaagacataaaacccccaacaatttatctcataattagcttccctgaggaggaaacaaactcacaaagaaacacatgtataattcatccttgcatatcacacttcccaagtaattggcttggggaggcacggattttgcattgcaaaagaatgcaggggtgtttgggggataataaggaaggggtctcattttggttaggaaattcccccgcatataattgctctttgcaaaacagagcagttctgtaaggaaatctcagctggttggtgcagaactctgggtctgtggttgctcagcctggcaggagagccagagggtttcagtcaacttcctggcctggagccctccctccctgtgttcctctgaagggtttgccccacacataggaacctgcgagaacaggaggaagggctgttatagccagggtcagccctgccttttttttttttttttttttagcagccttatcgaggtatagctgacatatcatcaaagcacccattagaagtactcaattctttggttttcagtaaatttactgagttgctcagccatcaccacgatccagtgtctggacctagcagaccccgtgccccttggtactcatccccattcccactccagccccagctcatcactcatctgctttgttgtgtttgtgtggctttgcccgttgtggatattcatatgcttggaatgaatacaatatgtggggttttgcatgtagcttcttgcacgttgagtcctgtttttgcagttcctccatgcagtggtgtgtatgggtacttcgttgttgttcatggctgaatggcattccattgtgtggagaaccacattttgttcatccgtttaccagttaacagtcatttgggattgtttctactttttggccactgcgaataatgatgctgtgaacattcacatacaaagcgtgtgtgaacatgtgttttcagccttcttgggtagatacctagagggagaactcgggacaggaagtctgttctcgtctggctgcaaacatcgttggttcaaatcctggcccaaccacttgctagctgtgtgaccttgggcatattacttaacctccatgtgcctcagtttcttcgtaagtaaaatagaaatgctcgttgtacctactcatagggtttttatgagggtaaagtgagttactgatgaagtgctttgactggtccctggcacatagcaagtgcaattgaagtgtttgctaattaaatactcgcttgtacttagaagtcatgggttattagagctggaaggagcctttgagagaactgagtttgtgtgtgtaactaacgtgttgaacccattggactcaaagggtgtaatcacaaaagccactggatttttctctcccacttttcatcctgcctggggcgggagttctttcctttgacttttccagccacccttacataacagagaaagtcataatgacacttgaaggagcgcacacagtctgaattcaggaattaaaaaggactcatcgcttgaagccgggaggcggaggttgcatgagccgattgtgccactgcactccagcctgggtgacagagcaagaccctgtctcaaaaaaaaagattcaggctgatactgatcaacgctctggtcctcattcaaaagtcagacccctctcccgtctccctgcaggcagcgacctgtggtcaggagctgggtgttgtctttttctccctaatcaccagctgcaggaaggagaggacaggggcagggaaagttgttacttgactagcactgttggaagctggctttgcgtgctgtgggcctggctgatgtttagttatcttccctcgctggctccctctggatgtaactcctgtgtcgtgggcaggggcctgtcctttggctgacagccccctcctcccagttatttaccccttacatcacctcctccttccatctctttctgttgagggattcagatcgtggaggactgcgtttgagcaggaattccttttcttttttctttatttttttattgggcagcccctggaaccagaataggttctgagagagactcccaggattccttttaagaagaccatatgctgggcacgcctgtaatcccagctctctgggaggctgaggtgggaggatcgcttgagcccaggagtttgagaccagcctggccaacatagtgaggccccgtctttaccaaaaatataaaaatcagctgggtgtggtggtgcgcacttgtagtctcagctactcgggaggctgaggtgagagaatcacttgagcccaggagaatgaggctgcagtgagtcataattgtgccactgcactccagcctgggcgacagaatgagaccctgtcaatcagtcaatcaatcaaataaataatacaaataaaagataaaccctaaggcagtatttctgtaatagggtcccccatctggtgtccagagttcaagcagcttcagcccactgttgagagggtgtggcagtatccccacaccttacagccccctgtctgctgctggaagttaacctttgctcacttgggtgccagtccactgtgtaatttacctacaggaacacatacacatggagctgagtcgctcagtgaagcccccttcaaaggctttgggttaggaacaagtggcgccacctttccaccaggcttatcccttggtcaggtcaactagggtagtcccctggactatgggaaaatcgtaccttacttttcttttctgtacttgattaatatgaaatcttgaaatttaggctctaacggtatctccaagggcctgtggaagatgtgatgatcataagttggtattgagtggcttgagttgccctgggcccacgcccttttggggacagtcctgccccaaatcctgtaacttgggagagggtaggcagcccagcatagctctctctaaagaagctgtctcagcaccacccccctaaactactctgtcaactctctcagccccttgatcagattagaaggtccctgggcctcggttataaacttgtgtcttctgctgtgtgtcttctttgctggtaatctgaaaatcctattggacaattctccaggagtccccagtggattttgtgccctaggggggctgagtcagtgcctgtgggtctcttggtcaccttgttctgaactctgcaccactgcactggtgtaggtacctaagagccgtagtgggctgtgaccagtgaccagtgtggtagggcataccttggaggaaatataggttagggagcatatggggccccaagagagccagatttttgtttgtttgtttgttttgttgaaatggagtcttactctgtcgcccaggctggagtgcagtggcgcgttcatggctcagtacaacctccaccacccgggttcaaacgattctcctgcctcagcctcccaagtagctgggaccacaggcacacgccaccatgcccggctaatttttgtatttttagtagagacggggtttcaccatgttggccaggctggtcttgaactcctgacctcaagccatccacctgcttcggcctcccaaagtgctgagattcaggtgtgagccaccgtgcctggcctatgagagccagattgaaggaaacccaattttccaggatttgtgcgtgattcagatgccccacaatgccatcttcacttggttttcttgacagaatccagcctttgggttagctgatgtacacacccaacatgcatcctgccagggagtgttcccttgagtatctgaaatagttgtgtgcatttatctctctctgttagctgttctgagagtggatggttaccttgtgaatacagtagtgaataaaatggagcacccagttttccattagtgccctgtaccttccagttacatggaaagatgctccaatatggctttggaaatccttacacgtgctactcttattcaggcagctttttttttccagcagcgcttcttcttgatgtagtgtatggatgagtgatgtcatggtgtgtagttctgaacttgaaggtagaagatatgggttctagcctaagcgaatcctttagcctctctgaacctcagttgcctcctgtgtaaagtaggaataatggtagatagtgcttcctctgcctaaccttccagagtcgtttgagtcagatggacaaggctatgtggagacaattggtaagccatcaagtgctcaccaggagtcagatttgtggcaggcagcctccaaaatgacccccaatgatccctacctcctgatagtcacacccttgcgtagttccctcccgttgaatgtggactggacttagcaacttgcttctgatgaataggaagaagtgggagtgatggtgtgtgacctggacactaggtcataaaaggcagtgtgccattcctctttctctcggatcagtctctctgagggaagccatgtctcaaaccagtcctatggaggatcccatgtaatgaaaaactgaagccccccactagctctatccttagtgagcttggaaactgatcctccagccccagtccagccttcagatgactgtagccccagctgacatctggactgcaacttcctgggagaccctgagccaggtccacccagctagttagttgctgctggatttcaacccttagaaacgctgtaagacctaactatttgttgtttgagttgatagatttgggggatcatttcttaaacagcagtaaataactaatatgaatgtcattattaaatccttgcctttagaaagagtgctgttcaccatggctccatatttttaaaaatctgcaaatttatttttaacttttgtgggtatatagcaggtatatatatttatggggtatatagactattttgatacaggcacacaatgtgtaataatcacatcagggtaaataaggtatttattacctcaggcatttatcctttgtgttacaaacaatccagttatgctcttttcagttttttaaaatgtacagtttttttttttttttttttttttttttttttcccctgagacaaggtctcactcccatctgcccaggctggagggcagtggcgtgatctcagttcactgcagccccaacttcatgggctcaggtgatcctcccacctcagccttccaagtagctgagactacatgtgcacaccaccaaccctgactaattttttgtacttttttagtagagatggggtttcgctgtgttgcccaggctggtctcaaactcctgggctcaagtgatccacccacctcggcctcccaaagtgctgggattgcaggcatgagccaccatgcccagccaaaatgtattgactatggtcaccctgttgtgctatcaaatactagatcttattcattctttctatttttttttgtacccactaaccatccccaccttcccccagtccccactgcccttcccagcctctggtaaccatccttctactctccatgtccctgagttcaattgttttgatttttagctctcacaaataagtgagagcatgcaatgtttctctttctatgcctgacttatttcgctttatataatgatctccagttccatccatgttgttgcagatgacaggatctcattcttttaatggctgaatggtactccattgtgtatatgtaccacattttctttatccattcatctgttgatggacacttaggttgcctccaaatcttggctattgtgaactgtgcttcaacaaacatgcgggtgcagatatctctttgatatactgatttcctttcttttgggtatatacctaggaatggggttgccggatcctatgataactctatttttaggtttttgaggaacctccaaactgttctccatagtggttgtactaatttacactcccaccaacagtgtatgagggttcccttttctccacatcctcgcccgcatttgttattgcctgtcttttggatatcagccattttaactgcagtgagatgctatctcactgtggttttgatttgcatttttctgatgattagggatgttgagcaccctttcatatgcctgttggccatttacaaatgtcttcttttgagaaatgtctattcagatgttttgcccatttttaaaaatctaattattagatgttttcttatagagttgtgtgagctccttatatattctggtgactaatctcctggcagaggggtattttgcaaatattttctcccattctgtgggttgtctcttcactttgctgactgttgcctttgctgtgcaaaatctccaaatttagaattaagcagactaaataggcttcaattaggaaataattgtaccaggatggacagttatttgaccagagccaattagccattgatgtttggtttagcgtttcttttctactgctggatacatctataaatgtattctcttgctctttgaagaaataaatttagtgattatattagtcagggtccaggcagaaaaacaaaaataaccccagttatttccatggagagaatttaatagaaataactgtttgctggttaccaaaaaccagaaaggcagaaagggaggccctgaggtatcaggaagcctgtacccctggggcttgggggtcaaatgggagggtgagattagaacttgttcggagggagtgtcaccaggctggagcaggtacctctgaggggcaagatgaggctggttctggaagtacggggtgacacacagcgggagactggggccgactgagggtccaacgccaagcttagggccacagcaagcacacagcaggtctccgcttcctcccgcatccttccagggtctctctttagcgccacctggttgcggagcctaatggggagctgcaggcgaagcagagtcccagactcagcatcacagagcagagctgagagagggtagcttcataagcagcacagtatcggatccttcctcaattagggattcgttagaaggcacattccctgccaagacctctccctctgttacagcagcaagagcccataggggatattgtgtcatcggatgttcccttcttggggctctgggatttcctaacagggcatcaagtgtaatgcgctgccatgttgcccaactctgcaactcactgaacatttccccgccagggcatcagctctggagaccaaagccatcatttgttcctcatcgatctgttgtgctcactgatacaacccaattcatatttaagtttatatttaagtcacttgtaattgaatacaattaaaacttaaaaatgcatttcttcagtctcactagctacatttcaagggcccaacagtcaaatatatgaggctagtgactaccatatttaaccacacaggatagaacgttgccatcagcgcaggacattccatccgtcacagctgcccctagagtatttaaagaatgctaataagacataggatcttccagagggggacacaggaggtagtttctccaaactttctttatagccagtgcgccctttgctttcctttttttttttttttttttttttggagactgagtctcgctctgtcgccaaggctggagtgcagtaatgcgatctcagctcactgcgagccaggttcaagggattctcctgcctcagcctcccgagtagctgggattacaggcacccaccaccatgtctggctaatttttgcatttttatatttttagtagagacggggtttcgccatgttggccaggctggtctcgaacttctgacctcaggtgatccgcctgcctcggcctcccaaagtgctgggattacaggcgttagccaccatgcccggccctgctttcattgattaaacctttagttgtgtaatcctcagataggcctttgaatttctctgggtttcagtgttctattcatgcgtggccaaggtcagagctctgactttgctgtctttttctaaatttctttgccagcccccaggagctgctgtcactttcacacacgtcccctttgcacaggctgagtttcaaggaaaacgaaggatgttattcgcagagcccttgactgacctccccgtgtgctgtctcccacaagagcacgtccaaagccagagccctgggcccaccctgcttgccactgggcctgtgcccttgccattgcctccttaactattcccacaccctgccccgtgtcagacatcgcttgttccccggaccgctgtctatctcacacccatgatcccctttgtccagccctccagccttcgcagcaggaccctgcttccctgacagccccggctaccaacccagcaaagttacactttacccaggctgctccccaccaaggcctgagcctggcaggggtgctagaacccaggtgggactcctccagtggatgacttggggctgcagactccccagcagcctggctgaagccctctccgggctgctctcccatcccagattcttcctgattctgccttcctctccgctcccaggtgttgcacctgccatgtggtccgcagccggccctgcccaccctgctccctcccgctttgtccttcagagaccttctccccaataaatctctcatatgtctcatctcgtcttggcattttactcctcagaggcccaaatggacacagccatagtgtttcctgacccgaaccaggcagagagtcaaaccctattttattaatgctcttgcagccttctgtgtatttctctgtcctagcacctaccacattttgccattactgccaccgctgccagcattctgtctttgtctcctccactaggcacctccctaccatcaggctgtgtttctcacgttctggcttccctgtatttggcatgtactaatatgtgctgactgaattgcgccatttgtcctttgatgggccaggcagtcctctctccacgtggttagtattaaaggaaggcatgttgcatgcctctgctcaaagaaatatgcagtcaggccaggagcagtggctcacgcctataatcccagcactttgggaagctgaggcaggcacatcacctgaggtcagagagaccagcctggcccacatggtaaaacctcgtctctactaaaaatacaaaaattagccgggcatggtggtgtgtgcctctaatcccaactacttgggtggctatggcgtgagaatcgcttgaacccgggaggcggagttcgcggtgagccgagatcacgccactgcactccagcctgggcgacagagcaagactctgtctcaaaaaaaaaaaagaagcaaccatattatttatgcatgggacaagactccatctgccatttgtgaagccattcatttcacagttagtggtgggttttttgttttgttttgtttttgagacaaggtcttgttacattgtccaggctggtctccaacacctgggctcaggtgatcctcctgcctcagcctcccgagtagctgggactacaggccacttagtttctgagcaatatggtacccacagcctgtttgtttgttttccaaataggcaccctgcagtacatggcacctgagataattgaccaagggcctcgcggatatggtgccccagccgatatctggtccctgggctgcaccatcattgagatggccaccagcaagcctccgttccatgagcttggtgagccgcaggcagccatgttcaaagtaagtcatgcttcgtgattgaggttgggcgtggttgggaagtagaattaaaaacaaagtctcctcccaatccagaaaacctctccacaaaggtaggagagaaggaaacagttttattattggataagcattaaaccagaatgcgaggtgcatcacaggcaatccactgagactgcaaagatggaaagcaatctcactgtttcatagagccgagcagacacaacccgtgacatctgtgttctcaagagaaaccgtaactagtcctcaagtaagacaacttggtggtgccatttgtcacaaggagctcatcttagattcacctggtgattggggggaccattggtgttcactgtttggcttcatccaaaggaaaatataggccgggcgcggtggctcacgcctgtaatcccagcaatttgggaggccgagatgggtggatcacctgaggtcaggagttagacaccatcctgggcaacatggcaaaacctcgtctctgatacaaaaatcagctggacgtggtggcgcatgcctgtaatcccagctactcgggagactgaaacaggagaatcgcttgaatccaggaggcagaggttgcagtgagccgagattgcaccactgcagtcccgcctgggtgacagcaagacactacctcaaaaaaaaaaaaaaaaaaaaaaaaaaggaaaaacactaaacttctcatatctttaagacagtaggtagttttggagtgaagccaccatcaaagttagaaacctaccttcctatttctgggagagcagagttatgaaaacattaataaaagatgacaggtttaaaaaaaaaaaagaaaaaggaaactaggagatagaggccctatcttctttgatgattacatttcagagagatggcttccaggtccttgcaaaagacatttctggcaagagtcttatttagccgtttaaaagattcacgtatatctcagagacagagaaagaaccttaaagttataagttctctcaagtcaaggctctaagaaagctgggcagggtgggggagggtcctttccctttattttcaacagggagaatccagccccttagtttcccttcatgtttgctcttacagtgggtaaggctcaaaggccatgtgggatctgtgcctttgggggacaggtttctgactggcttctggagaggtgggagttgggctatcaggtaaatatatcccttatcattccaacaaccctccccgagctaacaggaagggcagcccatgtactggggccaacatagtgcagattgagcattgcgggtgggggttttaccgccgagcagccaagattgtggaaagggatgtccttccttgtgacctcacgggaagctgatgccaggacaccccggtgtacccaaggttgggtgtgcagcttctggcctcatgtatgcttagaaacatgtaaggggcttgatgtggtttggccatgtccccacccaaatctcatcttgaattgtagttcccataatccccacgtgttgtgggagggacccggtggggataattgaatcatgggggtgatttcccccatccagttcttctgatagtgagttctcacgagatctgatggttttataaggggcttccgcctttgctggttctcattctctctcctgccgccctgtgaagaggtgccttctgccatggatgtaaatgtcctgaggcctccccagccgcgtggaactgtgaatcaattaaacctctttataaattacccagtctcaggtatttcttcatagcagcatgagaacagactaatgcagagctctagccctaggatgccattaccagcactgaccttccatggggcactgccttgagacagcagggtcacaaaaggccaaatggccattgcttatggatgatgaggccgcagtgtgtggacacggccctgatagaacgcgattccagaggcgtcttcctggcttctctgccaaacacggtgccttcatggcctgtgtctgtgccaggctctctgcttccctcttgggcagaaggaacttggaggtgtgagtgcaggtttctgccggttgaggtgagggcagcatgttcaatgggtcccgagtgctgcctgcttgggtgccttggctgctctctccagcccggcgaggcccctgcagaagggtctcagagcttctcacctcctatcagctgcttgggttcagagcccaggccaagacctcaagtcgacaagagtcttctgatacctgcaatcccaagaggaccctcagctcctgggctggaagacagcaatgaccgtcctcagcactttgaccgtgtgcggtggaccctgttggggccgttgtagatctaacctgcagcttccatggcagcgttggaataaacagcagctggtgacgaggaaaacatgaggcccacctgagagccatggctggctgctttttgacctgctgctgacttccgggaaaccagggagagagctgaaggctgtgactggctcgattcctccgcagggcatgcctggctccccgcctcctcttgtttttgtttagcgaattcactgtacaaagtctctctttttttttttgacagagtctcactctgtcgcccagactggagtacagtggcacaatcttggctcactgcagcctctgcctcccgggttcaagcgattctcctgcctcagcctcccaagtagctgggattgtaggcatgggccaccatgcctggctattttgtatttttagtagagatggggtttcaccatgttggccagactggtctcaaactccagtgatccacctgcctccgcgtcccaaagtgctgggataacaggcgagagccaccgtgccccgcctgtatgaagggtttgaaaatgtactgacttttttggatggcatatgaagtcacttttcattgccaatgagaaagttattattaaataagtaatggcccctgtgttatttctgggatccttcattcctttagaaaactttcaagaaacttctgggcagtgtctgaaacaaaggacactctctttcccctgaagggactgttacagatttaactgtgtcacccaaaaatgatatatggaagtcctaacccccagtacctcagaatgtgaccttctttggaaatagggtctttacaaagaaaatcaaatgaaaatgggttctggaatgtgggccctaatccagtatgactggtgttttggactttttttttttcttttttaaatctttctttttattttttttaactagtcaagtgaaacagtgggagtggggaaggaacaaagaaatctctaactggttgtcatcaactagctgcaaacaccactgcactcggaccagcctggtgtcttttaaaaaggggggatatttgagccaggtgcattggctcacccctataatcccagcactttgggaggccgacgcaggaggatcacttgaggccaggagttcaagatcccccggggcaacatagcaagaccccgtgtctacaaaagatgaaaaaattagcccatgtggtggtgcacacctgtggtcccagctactcaggaacctgaagcaggaggatcccttgggcccaggagttggaggctgcagtgagctatgatcatgctactgtattccagcctgggtgaccaagtgagaccctgtctcaaaaagttggggggtgggggtggagatttggacacacatgctcagaagacaaagtacgattcccaggggaatgcctcggggaggcagaggagagaggggggtgcatctaggagccaaggagcgccagagaccgcccgcagaccacgagaagctagaagaggcaaaggcggggattccctgcatgtttcaggagtccctggccctaccaacgcttggatcttggacttccagcctccaggactgtgagacaataagcacctgttgtttcagccacccagtttgtggtattttgttacagtggccctaggagaccaatacaaggagcttttgggtcacggcaaagcacccttaaagaggacatcccagccgggtgtcattgtgctgcccacatttgctgttttcagagagccgggcagaggccaccctttccttttcatgttcttgcctgaatgttggtctttgtacccctagtgcctgtgaacagtgccagcttaacctccctaccgctcaggtgagaggagccacctgtgaggcaccctgcattgcagacctggcggtgggtgggatttcacccagcatttagtgttcttcgaatccgtaactcctgagctgggcagcctggccaggaggagcgctgtgttggaaacagcacatggccgtgactgccaggtcaagggccttggggacaggaagtggggaggcctggccctctacactctgcagcaccctgagctcactcggcggggattgtggaggctgagccagcccccaggagctctgaggagctgggaatgggcatgggtctggaggacagaacagcttccacgcctggattgttgggtgggcttggaaaagacacagggtggactgtgaaactgaaggtgacaactcctaaaaagatgagagggccaccctactgggaacagttatgaaggagggggctatataacatgtcacggaagcatgtccgtgtcacagcgagatgtggcagctcagaaccaactcttacttccctacaggtcacagggacagagagccattagttacctgtctatacattggcagcctcaaggttttgtctgcttgtggttttgagctggaggctgggaatctgggctgtggatgcagagggattgagaggtgttaaaggcatctcttggggaccctgtgcgtcagggaacaggtaacagatgcctttgagtatccttagaggacatgccgccctaggctgtggcccaagtcccatctcagttctctactgctatgtaccaaaccaccccaaaatttcagaagcttaaaacgatgactttttctcatgcctctttgagctgactgttggctcttctgtgggttttgcctgggctcactcacatggttgcagccaagtggtggtttgggggagcagggtggcctgagaggcccctccctcatggcagttccagctgggatggctggggcgtcctctccacggggtcgtacctcctgggcttcctctctgcatggtggtctcggggctttaagggtgactagcggagccacaagacctcttaaggcccgggccctgaaactctcaccatgtcacttctgtcactatctgttggtcaaagtcaagtcacaagatgccagtgagggggaaatggactccaccttggggtgggaggaacaagaacgtgacgttgcaagggggcatggattatgcctgtcctgggatgtcaggtgtacaggagctttggactgagacatggatacctgaattcacccaaggcctcactgacacatcggttacctctcccttaaatgcaggtgggcatgtttaagatccaccctgagattccagaagccctttcagctgaagcccgagccttcattttatcctgtttcgagcctgacccccacaaacgtgccaccactgctgagctactgagagagggtttcttaaggcaggtgaacaagggcaagaagaaccgaattgccttcaagccctcaggtgaggcctccctggacagctggggcagcaccctggccacaagaatgctgggcgctgggcttctctgctgctcaggagggagagttctggctatccagagccctgggctgctcacgtcattcccatttttgtgaagagtgacggggcctgtgcagtaggtttggaggttgtcaaaatccaactaatacatgcacctcgatctcctgacagaggcccagggagtctctgggtgactgggctgccgtctgctggaagttgttccttcgggattgggaagagagtggggaggcaagaggtaccccagctggggttctgcgtcttcaccatgtgccagagcctggggcttcagttttggagcctggcttgtcatcgtgtgccaaccctgaccttgattaaaggatttgtcagggaggtttgcctgatgtggctgtcctgcaggccaccgaagtccagtgacaccttctggggcagtaagtcctaactggcaatgatgtaagagtggcccctgaaaaggaagcagtttgtcctcttttccctggtaccgatcggggtcagaagctgccagagtgagtggctcagcaacttgctccatgagggacccccaactgcatgcatctgagtagaaatacagcacctgtggcccgtcccccgcccaacccacatttctacaggatcctgggtgcctgggcggttcacctgggcttgaggggctgccagggactcagctccaccccgtccctctctgagtctccccattcggtgtctggctgtccccctacagaaggtccccgcggtgtcgtcctggccctgcccacacagggagagcccatggccaccagcagcagcgagcacggctctgtctccccagactccgacgcccagcctgacgcactctttgagaggacccgggcgcccaggcaccaccttggccacctcctcaggtacacccgtattctgtctgtctgccgcgggcccgaaagggtgctggtagtcctccgccacagggcacctccctggtcccaaccagatggccactgaggggttttacttcccttctgcagggcagtagggcagctgagccgccccatcccggcaaggagggtgcttcgttcacttgctgtcccttcccctccctccctgtcctttcattccccacatgtgccctcccccacctctcctcttcccttctctctcccctctccttcgacacttcccctctctcctcttccccctctctctccccctcacccttgccccctctgtccctgcatcttccggccccctcctcctcctggcccctcctcctcccttcctccttttccttcctctctcttcctccttcccctgtccccctcaccttccctccctcacctctccttctgtgcttgcccccttccctccctccctccctcctccctgtctcctgggaggctcctttaccccgcctccccctccttctgctctccctcctgctgtgggggttgacagaacactgcatgtctgtccttcctccggcaatttcatcttcttgagcacagggactgcatcgcagttacctctcagcccttctccagggcgtcctaacatgacacactcccagggacagtgccccggcacgcacagagattgtcacacgtgtttgtccacagtgttccagacgagagctcagccttggaagaccggggcttggcctcgtccccggaggacagggaccagggcctcttcctgctacgcaaggacagtgagcgccgtgccatcctgtacaaaatcctctgggaggagcagaaccaggtggcttccaacctgcaggagtgtgtggcccaggtatttgcccgagggagggcaccgactcttcccgctccctctgcccaggtcccagtccccagacaggtccaatcaggacctcagttcctgccgccctggaacatctgcatagttacggtgatcactgtaaatgtttccctaacgtccttcccttccccaacaaaacaaaagaaaatacaaagaaaaaaagctctgccgaaacatgaatttgcagataccgcagtgattccaggcactggtggggcggtgctgccccctggtgaaaaccagccagattgtagcagaaagcccgaagcaccttctctggcctctcatgatccggttttgagtcctggagttaatccccagctgtaggacacgctagagctgccctcagaagctgggagaacagccaccttggggagggtggttatgggtgaaaataactgattttgaactagggcacaggactggcaaaccgattcccctccattatttcagtttatttattattgttttttaatcttttttttttttttttttagacagtctcactctgtcgcccaggctggagtgcagcggtgtgatcttggctcactgcaacctccgcctcctaggttcaagtgattctcccgcctcagcctttccagtagctgggattacacagcgcctgccaccacacccagctaatttctgtatttttagtagagatggggtttcgccttgttggccaggctggtcttgaactcctgacctcaggtgatctgcctgcctaggcttcccaaagtgctgggattacaggtgtgagccaccgtgcccggcccccctcccttatttcagatggaaaagggccttttaggaagaggccgctgctccgctctgaactatgtctatggccttgatgggggctcttacaaggggttaaacaggaagccattcacagaggggcttagctgtacacccaccagggagaaggggccaggaccctgacaggaaggttatggagggaacaaacagagaccccttctcacctgggagttccacaagtttcttagcaaatggaccatcttgtttcccccagtgtgttctgaactctcgctctctcaatctgactcaatgaaaatgatttgtgtgtgttttcagagttccgaagagttgcatctctcagttggacacatcaagcaaatcattgggatcctgagggacttcatccgctccccagagcaccgggtgatggcgaccacaatatcaaagctcaaggtggacctggactttgacagctcgtccatcagtcagattcacctggtgctgttcggatttcaggatgccgtaagtgctccatctggccctagggaacacaccagatcttggaattcagttaccacctcctcccatagcccccatctcttcttaactgtatacacctgaatcccaagcttcagcagctcctcctaaacaatgaagtccaggaaatggcatctgggtgaactggctgattgcatgcggcccccaagaggatgagtgtaggttgccgtgattctccgtgcaatgcactggaaatctggatttttgtgattttagtttattttattattttttttttttttaggtaaataaaattttgaggaaccacttaattaggccccactggatgttcgcgatggacaacatcatccgccgagcggtgcaggccgcggtcaccattctcatcccaggtgagcgccccctttgtggtcaaggtcagctttaggccgtgaaaagataagaaatatcctcttcattcaacagttgttgcttttctcttttccatcttggttatctacttccttggaattaaatgcatgttgtcatagacttcttccggggctgattctgtagttctgagagcatctcgtggtgctgtatttacgtgtccctgaagcatgatgaaggtgactacacataaactataactcacaatctcaaaagggagcatggggccggacgcggtggctcatgcctgtaatcccagcactttgggaggacgaggtgggcagatcagctgaggtcaggagttcaagaccaggctggccaacatagtgaaaccccgtctctactaaaaatacaaaaaattagccaggcttggtggcacgtgcctgtaatcccagctactcgggaggctgaggcaggaaaatcgcttgaacccgggtggtggaggttgcagtgagccgagatcacgccactgcactccagcctgggcaacagagtgagattccgtctcaataaaaataaacaaatacataaataatattaaattaaaagggagcatggggccagaggggaaggatcctccagtcctctggtatccccttcatcgtgcactcaggaatgtttcttgggtaactgacaatacagtggctcagattcctctctctgaatcatcatgtagtagttacagaagtttttggtttttgtcaatttcctttttgaaatgttaccaaagttgattctccttctctggtgacttcttcctgctaagggaggctttacagcccattctgtcgccatcatggtttccccctttccttcagctccttgctgtttggctccagcccaccctcccgaatgcactgtgtagcccaggctcagctgcaggagaggcttgggaaaccccagtgcttaattcctctcccactccaagcagacaccttctgtagtaaaacggcacaggcttgggtggcagcctggctctacttatttctttcttttctttttttttttttctgagacagagtcttgctctgtcacccaggctggagtgcaatgatgcgatctcgcctcactgcaacctccatctcccaggttcaagcaattctcctgcctcagcctccggagtagctggggctacaggtgcgcgccaccacacccagctaattttttttagtagagacggggtttcaccatgttggccaggatggtcttgatctcttgaccttgtgatctgcccgcctcagcctcccaaagtgatgggattacaggcgtgagccactgcgcctggacctggctaatttttgtatatattttttagtagagatggggtttcaccatgttggccgggctggtttcaaactcctgacctcaagtgatctgcctgcctcagcctcccaaagtgcttggattacaggtgtaagccattgctcctggcctggttgtaccttttgaacgctggccttggttcacttcatatccttaagcctcaatttcttcctgtggaaactggcgtgatcaactttacgctgcagagaaccaaatggaacagtctcttctccatttgtaaagtcagcagtcccctaatggagcatggcacgggctgggccagcttctgaacagcccggtttgctgacctgggtgtctgcgaccccaggccccactggcctggtttgctcaccattgtcatgtcttgtgtgatttgcagagctccgagcccactttgagcctacctgtgagactgaaggggtagataaggacatggatgaagcggaagagggctatcccccagccaccggacctggccaggaggcccagccccaccagcagcacctgagcctccagctgggtgagctcagacaggagaccaacaggtgaggagcttctgggccctcctctgggagcaggcgctgggacagtggcctgagccaccaagatgctgattaattggctttattgttgaccatctcacccaggtcttaggaaaaagcagcttcatcatccacgaactaggcaagggcgcatattctcagcctcaattgagggactagaggaatgccttcctttaaaaaaaaaaaaaaaaaaactcagaatcagagaggtatatatagtaccttgccccagaccacacagaaattactcatactaaaggcagcagcatctgtgaattctttctctcttttcaccaagacggggcccctggcatggtgtgtgggtctcgcaggctcagcagcctgcccctgcagaagtagcagggtttgggggttggttagcacttcatcagtggatgtacatcccataatcccgaccccgaggaagtttgtcctgttgtcatttcttccatgtgatttgtcatgatccctagacgggcattagtggactagcttcccaaccagggaaccctggcatcaccatcatattcctccaatgcactggtctgttttgttcacttcctggcacatagtaggtgcttaatatttgtgaagtggatgggcgtggtggctcacgcctgtaatcccaacactttgagaggccgaggtgagtggatcacttaaggtcaagagtttgagacagcctggccaacatggtgaaaccccatctcttctaaaactacaaaattagccaggtatggtggcgcacgcctgtaatcttagctgcttgggaagctgaggcaggagaatcgattgaatccgggaggtgggggttgcagtgagctgagatcgtgccattgcactctagcctgggcaatgagagaaactccatctgaaaaaaagaaaaaaaggggaagaaatatttgtgaaatgaataaaattattcctgtttgctctgggaagtcacattatcagctgcgtgatttggtttttaaaagtaatccatagttgaccgggcacagtggctcacacctgtaatcccagcactttgggaggccaagatgggtggatcataaggttaggggttcgagaccagcctggccaatatggtgaaaccccgtctctactaaaaatacaaaaattagctgggcgtggtggaacttgcctgtaatcccagctactcaggaggctgaggcagaagaattgcttgaacccgggaggcggaggttgcagtgagccgagatcgtgccactgcactccagcctgggcgacagcatgagactctgtctcaaaaaaaaaaaaaaaaaaaaaaaaaaaaaaaaaaaaaaaaaaatccatagttatagcaaatgagttggtactcattccaaatgacactttgttgctgtgggatcattgctgaggaatgctaatgactatttaaccgggagacaaggggccagttacgtattttggatgaaaggttgtgtatgctgtcagggatctctcaagttcaatcttagatcatctaatcatttctttttttaaaagacccagagctttagttaaatggtagtggtggcaacattttgaaagtttttttttttttttaagttcaagagtacaagtgcaggttttttacacaggtaaacttgtgtcatgggggtttattgtacagattgtttcatcacccaggcattaagcctagtatccattagttgcttttcctgatcctcctcccagcctccaccctctggtaggccccagtgtgtgttgttcccctctatgtgtccatatgttctcatcatttagctcccacggcacgtggtatttggttttttgttcctgcatttgtttgctaaggataatggcctccggctccattcatgtccctgcaaaggacatgatctcgttctttttttatggctgcataatattccatggtgtatatgtaccacattttctttagtctatcatcaatggacatttaggatgattccatgtctttgctattgtgaatagtgctgcaatgaacatatatgtgcatgtatctttataatagaaccatttatattcctctgggcatatacccagtaatgaggttgctgggtcacccaataagatttataatcaccaaattcataaaatgattatatatgggtttgaaggttatttctctccactgtcgatagtcattgtgttattttccagtctcagtggaatgaggaattggttaggcagcagccagtctgtgaatggcattgacgtaaactgtacattcctgcataaggtgcttgtccttgtgtgtattagtccattttcacgctgctgatacataccagaaactgggcaatttataagagtaagaggtttaatggacttacagttccacgaggctggggaggcctcacaatcatggcagaaggtaaaaggcacgtcttacatggcagcagacaagaaagaatgaaagaaccaggcggaaggggttttcccttataaagccatcagatctcatgagacttattcagtaccatgagaacagtatgggggaaaccacccccatgattcaattatctcccactgggtccctcccacaacacaagggaattatgggagctacagttcaagatgagatttgggtggggacacagccaaaccatatcactgtagtatgaagtgccttggctatgtggcagttgggcagagccaaaggaagatgacacctcttagacaggatgatgtgtctgtcctgatgaagtcctgagagtccttcccactggatacaggcacaagcttgagttgtctccttcactaacgtaaaaggaggactactagagagaccaggatgaaggcaggcagttgggcagggctgggagaggacttctaatttgctgagtgccaatatttcctctgctgttgtgctggggcagaagtgttctcctctccccaccccactttgccaccaaataatccaggagttcctgtgttctcatctctctactgttgcagtgacttctcatggcaacttcaataattaccttcagtctttttttttttttttttttttttttgagatggaggctcgctctatcatccaggctggagtgcagtggcacattcttggctcactgcaaccttcacctcccgggttcaagcgattctcctgcctcagcctcccgagtacctgggaccacaggtgcacaccaccacacccagctaatttttgtatttttagtagagatggggtttcaccatattggccaggccggtctcaaactcctgacctcaggtgatccacctgccttggcctcccaaagttctgggatgacaggtgtgagccaccacccccagcagccttcagtaatttcaataaagcttagttctgtattcccaagttcaccagcatggatcatataaatgaattaaaggaacacacagttaagaaacaaatcccatgtactaggtatgtaagcaaacaataaaagtgtgggggccaaggcccttggcccctggaggtttgctgaaaatcacctgcatgaggctgattaatgagagaaaaggcatgcaaatgtatttaacatgtatttaacttcagcatgaagacccaaagatccaggggaaattgtccatttttatgcttaggcttaacaaagtatggagagctgtggagaaacagggataaaaagggcctgatcgaatgctgatagactgagtggggaaacccagcaaggcctgtctgtctagatccttcttggcctctctgagtagcattcctttctcctgggtgtggggcaggaccctctggaatcgggggtcttatgaactacagtcaaacaaagtaggtcgaagaactttttttttttttttttgagatggagtttgactctgttgcccaggctagagtgcagtggtgcaatctctgctcactgcaacctctgcctcctgggttcgaactattcttctgcctcagtctcccctcccgagtagctgggattacaggcgcacgccaccacaactggctgatttttgtatttttagtagagacggggtttcaccatattggccaggctggtcttgaactcctgacctcaggtgatcctcccgccttgacctcccaaagtgctgggattataggcttgagccactgcgcccagcccaaagaatttttttttttttttttttttgagacagagtttcgctcttgttgcccaggctggagtacaatggtgccatcttggctcaccgcaacctctgcctcccaggttaaagcgattctcctgcctcagcctcccaagtaactcggattacaggcatgtgccaccacgcctggctaattttgtatttttagtagagaggcttctccatgttaggctggtctcaaacttctgacctcaggtgatctgcctacctcagcctcccaaagtgctgggattacaggcttgagctgccgcacccggccaagaatttctttataaccaatttttacacagaaaggcggagggaaagttagagtcgtatttttaggttttgtggctggctttggggaggagttctggtttctgtgccccgctttggggaagagggattctatggtgcctccaggagaatggactgagagagggaggcaggagaaggtcagaggaaaactttttcttctgaggctgctgctgaggccatttgggggcactgttttctgagccccaacaaaagctagacgtggttccaatctgtcagccctttcccccaaggcatgctatgcctgagctggcatgtgggggaagtttgaggcacagttgtgccaagtcatatctgatcccagagagcccatgagcaagactgggtttcaggaggcggtcccttgggaagagcccagcctgtggactctgggcgttacttaactcctctgcctcagttacctcagcttcaaaacaggggtttagaacaaccagtgcttcctagaagtgccgcagggcttcagtgactgaattcatgcagtgtttggcacagtcctggattctgggtaggaagtgcttggtggatgttggcaggagccatcctccccaccggcagagcagcatgtctcactcactgtccctgctctgccccattacaagcaggggcttccagctgggtgcggtggctcacacctgtaatcccagcactttgggaggccgaggcaggtggatcacttgaggtcaggagttcgagaccagcctggccaatatggtgtaaccctgtctctactaaaaatacaaaaattacccatgcatggtggcgcatgcctgtagtcccagatactcgggaggctgaggcaggagaattgcctgaacccaggaggcggaggttgcagtgagccgagattgtgccactgcactccagcctgggccacagagtgagactctgtctccaaaaaaaaaaaaacaaaaacaaaataagaagcaggggcttctgtccccttcgtttagtccctgtgtgaggaggaaagaaacttaccattctattctagtttcagctgccttatctgacttagggagccaggtttaaataatcacatcgtccttctggctgagttctgattaacatcggcatcttttggttcacgatacgtttttgagacaaaactgcctgagtgcgttcaggctactgtaacaaaataaccagagaccaggcagcttataaacaacagaaatgtgtttctcacagttctggagactcgaagtccaagatcgaggtgccagcagattccgtggccagtgagggcctgcttccccattcacagatggccatcttctcgcggtgtgtcctcacatggtggaagggatgagggagcctctggggtctcctttcacaaggacactcctctcacctcacctctcaaagctccgtctcctaacaccatcaccttgtgggttaggatttcaacatatgaacttgggccgggtgaggggcacacattgagtccattgcaaaaatatatccaagctgtgagcactggcctttgttgtcaaggggaggaaaacacaaggaaggttcccctctgcagactgaagtctgagtcacagaacctgaagaaacacatgtgcttccctctctaggctgactcttagacttgtcccattttccattttttttccatctctaatgtatgcacaacagatgcttgagttaaattgaatggtgttgaatgctctctggataatggctttttttttttttttttaaaccagacttttggaacacctagttgaaaaagagagagagtaccagaatcttctgcggcaaactctagaacagaaaactcaagaattgtatcaccttcagttaaaattaaaatcgaattgtaagtcattttccaatgagacagactttaacatctagctaatattctagttagctttgaagaaacatttgaggttatcttctgttaatccaggactccagtagattctagactacttctcaatcataaaaagggactactgatagattcaacaacatggctgcattgtaaatgcagtatgctaagtgaaagagctagattcacagccagcaccgtagctcgtgcctgtaatcccagcactctgggaggctgaggctagcagatcaattgaacccaggagttcaggaccagcctggtcaacatggcaaaaccccatccgtacaaaaaatagaaaaaaaccagctgggcttggtggatgcatgcctgtagtcctagctacttaggaggctgacatgggaggatcacctgagcccaggaggttgaggctgcagtgagccgaggtcatgccactgcactctggcctgagtgacagtgaaaccctgtctcaaaaaaaaaaaaaaaaaaaaagattcaaaaggccacataccatgattccttttcctccagaaaaggcaaaactacagggacagaatcagaatggggaggtgacgggactgattgtaaagggcacatgaggacttttgggagtgacagtcatttctgtatctgtgctgccaccttcatagcacattggacacctaaaaagggtagtttactgcataagtaaataaatatgcctccatcaacctgacattcgttttgggccacttagaaacgagctccagagctacctcttggaatgtggactagataagctctgacctcaacactaaaacctatttccttgtaggatttccagtgcagttagggatgtgattcctaaggaaaggcatttgaaagatgtggggataagcatttaaagtggtagacctaacatgtcaaattccaaactaactgaaggtatcctagatgaggaggctttctagaaagtgaatctcagaattatgaattgtgtaatacgtattagcgtggttcagtgatacagggttaattcatctctttttcacatcacatttacattctggaatcatttattaatccaactggttacttttgaagagttttatggttagactaatatataacaaattgccaatcgttacaggtattacagagaacccagcaggcccctacgggcagagaacagataaagagcttatagactggttgcggctgcaaggagctgatgcaaagacaattgaaaaggtaaatttacaacaaagaaattcttatgctgttgttacacagctgctcagctcttaaggatctgatctttgtttcagattgttgaagagggttatacactttcggatattcttaatgagatcactaaggaagatctaagataccttcgactacggtaagagcctcaaaacagtttgtataagagaatacaactttttatgtgtgaatatgcttcaagagcagaaaacaaagggctgggcctccccccaaactctggagttctattaggttcaagctgggaaaaagccaaggtggggcagaaactgaaagccaggcagaagtcagaaataggaatgtgacagagaagagctggccaatctcctgccattaatgcctggctgggagtgggtggaggcacatggcaagcgtgcctgcacgctggacccacccccttctttaaactgcagcctgccttcttgttcccgagtcatttgaaatagccagctctctgcaggtacgtacctctaaggccatgtcctactactgctgggacacgagcgtcacctccatatgtgaggagaatgtttttattttcattaggtttttaaattagggactgcagttttaagctctgttggcttgaagcactgactctgaagacagctgtgtttgtttcccaggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttgtaga

SEQ ID NO: 3208 - DNA, 155205 bp, human; identical to SEQ ID NO: 3204

SEQ ID NO: 3209 - DNA, 100069 bp, human; identical to SEQ ID NO: 3205

SEQ ID NO: 3210 - DNA, 125845 bp, human; identical to SEQ ID NO: 3206

SEQ ID NO: 3211 - DNA, 122220 bp, human; identical to SEQ ID NO: 3207

SEQ ID NO: 3212 - DNA, 155205 bp, human; identical to SEQ ID NO: 3204

SEQ ID NO: 3213 - DNA, 100069 bp, human; identical to SEQ ID NO: 3205

SEQ ID NO: 3214 - DNA, 125845 bp, human; identical to SEQ ID NO: 3206

SEQ ID NO: 3215 - DNA, 122220 bp, human; identical to SEQ ID NO: 3207

SEQ ID NO: 3216 - DNA, 171687 bp, human
tttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaag

SEQ ID NO: 3217 - DNA, 264058 bp, human
gagcacggaacttattcctgcccagagttcagacacagccagaaattaccatttcatacttcacagaatggaggtttcagcagccaaagccccaagtgccgcagacttgtctgagattgtaagtaggccatacatctgttttgattgttgcgatgtctgcatcttttgtagcctgttgcccgactactttgtaggccaggagggaggcatgatggggaatttggtctcaggccagtccttccaagatggtgaccaacactgttttccacttggccccaggtctcagttttctggtttatagccgaagggtatttctttcactaagcccttgtctgtgatagaagtggattctttggctgagttccttttgtagtggcatttataaagattttgaatagctctgtcatctggtttggtggctctttccctctctgatcactatcgacagccaggtgagttttctccaggggacacggcacacagatagctgcattcaaccaaaccccctgcaggcatccatttctgcagtgaggtacccctctcaggggttgggagcaggtaacatttctgatgcagctggcagatctgggaatctaggggggaagccaggtgtggaatttagctttcctgtagtgtgaagaaataaagggggtgggggtaagaatgagatgggagacaggagagaaagtcagcttggggtctgtcaagagcactgtcctgttgccagatgccaactgaggtgtcgggagaggttcagttccccactcagctaactgtgcagccatgggctgctaaccaagatctctccaagtcttacttttctcatctgaaaatctgcatcctaccacctcgcaggactactggattgtttaaagtaatgaatgtgaaggcacctggtgcttggttgccatccttctccttttccatggcactctatgccataaatgcaagcagtgtgctgggctctgtgagatgccaccagtgttgctgtcctggcttgtttcaggccatcttttgtggccaccaagttctcatggtcagtgtcataggtttgatcttggggttggccagttggccttgcttaagtatgtagccccaggttgcccttttagtcatggccaggtgacccgcctcccaaaacaaggtcctggggaaagggtatgagtgagtcatggttatgtctcatagctaacgtttaagttaaagatgatgggaactgaggacccaagttaggaggctgtgttacaggtccttggggagagtgataattcaaaagacccctttcccgtccagctttgagtttccaacttattaaaacctatattcagccagagggagggagaaggaaaacaaaaggtaaacctcggccaggcacaatggtttatgcctgtaattccagcactttgggaggccgaggcaggaggatcgcttgagcccaggagttcgagaccagcctgggcaacatggtgagaccctgtctctaccaaaaataaaaaaaaattagccaggaatggtgacacacgcctgtagtcccagctactcaggaggctgaggctggaggattgactgagcctgggaggtcgaggctgcagtgagccatgatcacgctactgcactccagcctgggtgataggagtgagaccctgtgtcaaaaaaataaaaataaaaataaaccttgattgaaaactgccgagcagtcatctgaattctgattcagaagtacatgtaggacaccgtcatggtacttttccattgtgttgtttcatttaatgtgtttatgaatttaggcagccaccatgcacgtcggtcaagccccagttgcctttcgtgtgtgtgtgtgtgtgtgtgtgtgtgtgtgtgtttagggcactttctagagcctgctttgttaattaactgtactatgtgctttatatttgctgtgagttaattaccgatgatagtgttcccttgccagtcacaagttctctcacccctttcccccattgaattcctcatatttcatctcatccataggctcaagttgtttgtctttgactggcaagactcctcaataatcgtgtatcagtgatctctgacacagtgctaacttttatcactgattacggagagacattgtataaatcatcaggacagtttgttttgcgtatgatgatttaagagcacctcttaaccaacatcaaagtaatatatcagagtgccaaccttcggtacttttcttttgcttttcattgaaatccactttcttttctatggtctactgggcctcgtatggtctggctttgcctaccttttcagcctcatcggggtcatcttcccactcggccactgccttctgccatattgagttctcgcctgtcccagcactgtctctgcgtctggtcacttgcaattctcactgctgggaatgcccctttttttctttttggctccttgcttggctggccctttctcttctttcaggtaccactctgagcagccctccagggccatcttgtctcaagggccagcctccatcttgagtttcctttctccattcccatcacatcaccacatttatttcctttgcagtccttatatcacagcctgtaaatattttgttaactcattgatggacttggtatttgatgtctctcccaccagaattttagctccatgagggcaggggccttgtctgtcttatccctaccatatccccagctcttaactcaattctagatgcatagtaaatgctcaacagatatttgttgaatgaatagttgctttggataattaacacggtgaattacttttaagtagtttgtgactgcaagctgatagagccagtcccatgttttatgtggctggccccctccccatctgcatccatcactgctctggcactttgggagcatttcagaccccagggcactatttctctgtcttggccagcccctggctggtgtctgggataaccctctgttttaagcatcatttttgttctcaaaatgaaaaccacctgtcttcaacgtgatttgcttaaaataaatgctttatttctttactgagaccttcttccctttctgcctttctccacctcctgccaagaataatgtgaaaaaccccattatcttggaaagtggttttccctctggttggaatacaaagccagatgacttaccaccaaatgtgctgggataatagctttcccctgccctgatgctctcagatgttagtgaggtctcgaccttggcacttcctttctttgtatatttccttgaaacttccttcctacaggtaaagaagctagcccaaggcaccacctaaatggcagtgggggtagggaccatgtctaagtagcactctgtggcagactgtttgccagctcactgacaccttacaccaattccagggagttgacagtttttaccaccattttagagatagcaaaatggaggctcactgaggttaggtgacttgttcctaagcacataggttgcaaccagccaagatcagaaaccaggcttgtctgactcccaaattcatcttttatttgttgatgtactcagtgtctcccagggctatatcaaccaagttctgcagttaaaaaaacatctggcaacctggtctacggtacacatcccatgtaactgaggtaagtttcctgaaacagtagctgccttcactgtgtgtgatgccctcttgtattctccattccattcaacagatgcttgtcaggaccttctaaactgattacgtggcccaccgattggtggcagtccatttgaaaacagtttgagggacattagtgtaggtgaggtgtaaactatgcttagtttatatagaggtttacatggtgtaagctattaaaaagaatttttatggcaatataatagacatacataaaatgcgcatgagggtacggctgttgaatttttacaaactaaacacatctgcataattagcacgagatcaaaacacacaccattgatttaagcttctttgaatcaagacagaggcatgaagtacaacagaaactgatagcccctcagtttgttgtgaattacgcacaaacagcttactccataggcagactctttttggaggtccgtagcttgcctttccagtgatggggtctggctggtatttgtttgagatctaagaattgccgaaggagtggaatatggcctctgtaatggcctcagaaattagcacaaaaggagggctgactgagaatgtgcctcgtaaaatgtgaacatggaggaggaggaggaggaaagggcaaggccccgtagttgagtacagaaacattagggtgtgagaatttgtggtcatagtaattgagaccaattttactgaaatggagggcggcaaaaggaggaaggaaaaggaatttgtgattacagcaccaagcccctagaggttaaagaacgtctctgtaaaataaggaatatctacctctcatggtgagtgttgacttttagagaaaattgttctagtatactgaactaaaatgcttaattcttggcaaaagatacagatgcatctccatgcaaaagcaagctaaagcaactttgctttcataatgtatgggttctgtaaagctgtcttggtggacatgccatatgtaattcatcataatggggtgtgcatagaaatgaaagggagcgaatatcgtaacatgccttgaagcattgagtgctaagttacaaagggcattaattaatacaacttaatgggattcatttatagctcacttttagtcaaactgaaatagctttcctgaatcagggactttgggataataataaatccttttgtctttgttgatcagataagctcttattcactgacttcctgttactttcttggcacccagagtcatgcctgggcactaaggatttgctgaatgaatggaaggagtaaggacaaaaaaaatcgtagctagcatttaatgagtgtgtactgtgtgctttgcctcttttatctgatttagtcatcactacaaggctgtgaggcaggcactgttatcattttcttctttattttattttattttatttattttttgagatagagtcttgctctgtcgcccaggctggagtgcagtggcgctatctcggctcactgcaagctctgcctcccgagttcatgccattctcctgcctcagcctcccgagatgctgggactccaggcgcctgccaccaagcccagctaattctttgtatttttagtagagacggggtttcaccatgttagccaggatggtctcgatctcctgacctcgtgatccgcccgcctcagcctcccaaagtgctgggattacaggcgtgagccaccatgtccggcctatttatttatctatttattgagacgggatctcactctcacccaggctggagtgcaatggtgcaatcacagctcactgcagcctcgacctcctgggctcaagtgagcctcccacctctcagcctcctgagtagctgggactatagttgcacaccaccatgcctggctgattttttttttttttttttttttgtagagacagggtttcaccatgttgcccaggctggtcttgaactcctgggctcagtgatctgcctgcctgggcctcccaaagtgttgggattataggtgtgagccaccatgcccagcattatcccttcttttagagccaccttatttcctctacttgcctggggaccgttctggtgtatgcctgttgtcctcgcattaacattgacatcacctgctttcattctcagatgtcctggtcagatgataaaccatttcactctgaaatgttctggtttggatagacagatgaggaaactgagacacagagaagccacatcactttccatggtcaccaagctagtaagatgtaaaggtgggattctttcctgggagtctgattccaggtcatgttgtctgatcactaagttctggtgcttcacagtttaagccaagggagagataatataggaaaaccactctttatgtttttcagcttcagtatttagtaaaaatcactgccaagttagcatctgaagtaggttaatgtgactcagggcagtgggaatgtgctaggtaaagactcattgaaaccctaagtgtgtgttcattagtaaacttggccaactactaccctagaatgataatagcattcacatgtgcatggtgctttatagtttacaaaacctcttctcccatattattgtgttgaagcttcttgtgcactcagaggtgggaggtggatggccagtggtgggatttccagtttatagaggaggatggggtaatcagcaggatagtacagttgcctgcctgaggcttcacggctagaaaagaggcagatccaggattcaacccaggtattccgcctcagcgatcagtgcattcccactttagcacgggtgcctcttagccagatatatatatatatatatatatatttttttttccttgagacaatgtcttgcttgctctgtcacctaggccagagtgcagtggtgtgatcacaactcactgtagcctcaacctcccaggctcaaacaatcctcccacctcagcctcccaaatagctgggattacaggtgtgcaaccaccatgcctgactaattttaaaatttttttaagagatggggtcccactatattgctcaggctggtctggaattcctgggctaaagtaatcctcccacctcggcctcccaaagtgctgagattacaggtgtgagccacccatgcctggcccagatgctcttatatagccatttgagggtgctgtttatgaagggttagggagtcacttgaagactcatttacccagagtttcttagccttggcactgttgatattttgagccagttaagcctgttgtgggggctgtcctgtgtgttgtaggatgtttaggagcatctctggggtctactcgctagatgccaatagcacaatcgcccgtcccgcccctgcccccaccccccgcccccgccagatccctccaagtcgtgacaacaaaggaaagcgtctccagacattaccaaatgtcccttgctggggcacaattgcctctggttaggaaccactggcctaacataatagccacatttaaaagagggaaagacgaccttgaaaatgttagacctgtcttcttcccctttctctagtttctaaagcatcagaaaaactgttgaaagacctgcaaaggggcaaaatagagaacaagcaacatgtttcatgttgaattctcttccgtggaagagcattgtgtctgccaaaggataagatagccaacatttttttaagttaaaaatcacacagttaaaaatgttttgatagaaaagttagaatagagatcagccaaaatatacatatgcagaatctcctgtaatcctactgccgagataaccatggttcatattttggtctatttccttctaaccttttccagcatgcgtatacaagtatatattaaaaaaataattttccaaatagagccataccaaaagctgttataaacagctttttaatttaaatgtgccacaaatacctttccatatctatgatacagagttactaaggtttgtagtattttgttgtatggctagcatatagtttattcacttagtctcctgttgtgtacgtttggtttgcttctaattttgtttttgctgttaacatgcaaaaccgtggtgagtatccatgtgcatacttacaccctttccagcttattttttttccttctagaagttaccatcactgtaatttttagtatccattgagtaagatattgaattcatagtgttctggattgtattttaattatgtcacatacctttacccctcaaaattacggaaatgtattgattaaaaatgtgtttatgtgctagacttgcagaatggggtgtggaaagttctttggttttctgattgaacgatgactaataagaaaccatttgggtttcgtgccttgttcatgaagcccagtcttaactgtgtcaggctacttcctgagtaggaatcagcccagtgaaggttgcttaaccgtcctttaagattctgttcactactgaaagaaattcaaggctatatgctcgtgaattctcattgctcatggatttttcttctatgtgttttaaattataaactcacggaaaagacattcagatggtagagaagagcataaagtttcctactttactcccctccctcttggtttttttttttttttcattctctaggatttttgtatgcttgtacaaatattgaaatacaaaaaaatttaaaacccacaaattgggcaacagaatgcaatgtgtgagccaagtagcttttttctacttaatgcatctttctatatcagcaccttattctgtttaattggtgccctatttggggttgttttcagcttctcctgcaacaagtcaccttctattatgagtctatccataggatacatgcttagcagtggagttgttgggttaagagtttatgtccttatggttttgatagatattgctaaattgcccttctaccagcaatatatagcttgacttgtttctatcaggcatttttttcatgcctggcataaattattgattaataagctgggaacacaaaggtagaatctcatctataggaaggagcatagttggttaggagaccatgtcttccctaatgaccattatgagtattggttttcagccttgagcatactcagggggatgtgtatttactggtttcctcctggggttggcctgaaactggcttttacttttttcaaccacagagttagaatatgcatataaagttgggagacaatacccagatagacaactttctgggagtattcgatgacatgcctcaattagaattgaggtggttagaaatggacccttattactaaagaggttgtgacatgtaaatatcagtgggtctctgaaatagaagcataggtcatttggcatttggtacactgtatcaaatggaacataatataataaatgtaaatgtaacatgttataatcatgttacagtcattactacccctcttatctcttccatgacgtcttttctgatgtttcttcattccccatcttctcccactccaagatgactttttttcacactgtccttaaaaaaaatatagctggtactgcatttagggctttaaattgttttattatcttggatcagatatgtatccctaatcaaattttaaccaacacttggtttctggtcctcttcactctggctgggtgtttggaacgtaagtattttgattggttgtccactctagaattcttctgatttcatggggtccctgtgcttggtaaaggagggctctctcctggacatctcccccttgtaggcccccagaacggtgctcataaaggactctgtcatctcagtcttcagagcactgctttcctgcctagggaagggcacagcagggtgccatcttttatatgatttggtatctgaaggagcagaggatggtagatgtttgaagatgattctgtgaaccctggtgggtacggcagctgccagagcccaggtaaccatgtgaagggctcatattttctgaaaagtcagggctttctgatgggcactttttagggtattcttggccaggatttttttttttttttttgagtcggcctgaagtgtcctggaaggtggaagctaaaatccatgtaggtttggcctcaggctgggcctcttagaggaggtggggcagctttcatttcctttctccttgagccccgagggctgacactgtgccctggggactctccctggcctttcccaggggatgacctcgagagagtcttaaaaagggaacaaaccaaaaagctgttatttatttttcttattgttcagataatatattttcctttatagcaaatgaagagggcttttagggggcaggcagtgtgatctgaggaaaatggcctctggggtcaaatagttctgggttggaatgtgggctctgtggctttttccctaaggggctattatgggccaaattttgtccctaacccccctgtacctcataatgtgactgtctttggagataggtcctttaaagaggtgattaagttaaaatgaggccattagggtaggccttaatccaatctgactggtgtcctcataagaagaggagattagggctcaccgagagataccagggacgcagacgcacagaggaaagaccatgtgaggacacagcaagcaggtggctatctgcaagccaaggagaggggccccaggagaaacccaatgtaccttgattccagccttcagagctgtgaggtaatgaatttctattatttaagcccccctagtctgtggtattttgttatggcaacctaggctgactaagatgggggcttttagcaagtcaggtcccctgattttgctttcctaaagagggaccacaacaccctgagttgacaagaagagtggacacagtgcctggcttctaggaggtactttcaaatggcagtggtggtggtcaccataatcatttaataatatgataatagaaatcaccacccccttccctcacccaagttttctgaccccgtctggtttgaggtttttctttttctttctttatttttatttttatatatttttttgagatggagccttgctgtatcacccaggctagagtgcagtggcgcaatctcagctcaccacaacctctgcctctcaggttcaagcaattctcctgcctcagcctcctgagtagctgggactacaggcatgcgccaccatgcccggctaatttttgtactttcagtagagacctgattttgccatgttggccaggatggcctcaaactcctgacctcgtgatccgcccgcctaggcctcccaaagtgctgggattacaggcgtgagccaccgtgcctggcctctttttatttttttatttttttaactttccttttaagtccttttcaaagagggttgcaaagaactcatgtgatcagagattggtactttataggttgagtgaagtattttcttttgagtaacccttttcatccttttcatctgttaacatattggaggtccaggtaaaattgtatttaggacaaggattctgctgccaaaatagattcaaagtgactttcagcgtggtgtgaatatttactgtacctgacacccattgtattagtttgcttgtgctgctgtgacaaagtaccacatgctgtgagtggcttaaccagtggaaatttattgtctggcagttctggaggctggaattcagagatcaaggtgtgggcagggttggttccttctgagggtcgtgagggagagtctgctcctccccttgcttctggtggtttgctggcgatctttgggttgtagacacatcaccccagtctctgtcttcatcttcacatggcattctccctgtgtgcatatctctgtgtccaaagttcttcatttttgtgttttttttttttgttttttttttttttttggagatagaatcttgctctgttgctcaggctggagtgcactggcacgattatggctcactgcagcctccatcttctgggctcaagtgatcctcccaccttggcctcccaaagcgctgagattacaggcgtgagccacagctcccatcccaaagttctcctttttataaggataccactcatattggattagcgccactcaaatgacctaattttaacttgatcatctgcaaagaccctatgtctaaataacgtcatattcatggatactggggataaggacttccatatcttttggggagatacaattcaactcataacaccaattatattggaaccctatttgccatctgtgcacctctgcctgcgtccggcagcttctcaggagaagtccctctgcctggtctgccattcttgtttgccatgcagatttcagcgaagaagtcacctgctggagaggccttccctggccaccctcaatatagagtgattgaatgagtgaaatagattgcagagtaaaattaaaatgtgattgagaattatgctgagcataatttacccttaaaagtgtgagagaactcctctccaccccacatcaatgttacttgtaacttttttgtatatgttggctgtgtccccatcacagatgctatttaaatatcattttgtgcctgtgaattgagatgtcgggcaccttctgaatgtcatgatgtttcctattctgtgtgcagagcatgccaagaggattcaatttgttgaatttggatctttttttgcaatgagtcactatttgattatgattttacaacaattcacagaatcaaactggctagaccccttctctgaaggacatcttgggtccagaaaacctgtgaatcatgaataagggaaacatttactaatgctagttaattatcagtgtttgttaaatatgttctccttgctgaaactgctaggggctgtgcagaataccgaaatagaataggcaatagctgtggcctccaggaacacacaattcacatcaaacagccaaaaaatagataatacatgcaaagtggtgtgagaaggtgtagtacagaaattaagaagaagtgcttgttgtggaccagaaagatcaaggcaggctttgctgaggaacttagttaggcttgggctgtgccttaaagagttagagatcccaggagaggagggagaataccagctcaagacaatattaacataatatcattaagctgtataatagtcacagtatatattgaactaccaggttttaataaaaattttcttcacaagatagatatgaaatgatttgtaacagaaaaatattgtatacatcctaaatgtccatcaacttgggatatataagttatagtacatccatatagtagaatactctacagtcagaaaaaagaatgaggatgctttttaccgctgtggaccttccaaatatattattgttcagtgagaaaagcaaggtgcaggacagtgggtatgatatgctaatgtatgatattttcttaaagaaactagaagttgcctaagaaactaataacctatgtgtggtagtggtagactgggagaatgggagctagattctgtgtggggatgtttgtgtgtatgtgtgtgatttgaatgatgtaaatgtatcctattcaaaaagttaggtgtgaagacaatagtatttggtcacactgttgctacccttaaattgacttagtgctttgccttgctgggacataataaacgaagataattagtgacaccagatatcttagagataaacttttgcatttgcccagagaatgaaattcccttgaccagctttcacttttgttggccgccacaagaaaggtttgaagcatagcactcaatagaggggctggtctaatgaacccctttttacccatcgtctagcttcagcgttatcatctgctggccaatgctgctttgtttgttctctctcctcctcattcttcccttcttccctggccttgattattttgaaggcaatgccattctgatggaataatttagaattattactctgacctcctgagtcccaccatggccccagacatgcagagtacattagatgcttaggtgggaaaagctgtctttaatggaatttggctcatcacattaaactcatttgattttacttaaaaaaatgtaaaaaattattgtgcaatacaggtaacataaaatgtaccatcttagtcatttgaagtgtatggttcaaatagcactaagtacatgcacattgttgtgccactaatcttcagaacttttttatcttgcaaaactgaaactctgcacccatgacacaccagctccccatttccccttccccccagcccctggcaaccaccattctgtgttctgtgtctgaatttgactcctccaagtagttcatgtaagtggaatcatatatgatttgtctttttgtgactggcttattctacttagcataatgtcctcaaggttcatccgtgtggtagcatgtgacaggatttccttcctttgtaaggctgaatcatatcctcttgtatggatataccacattttgtttttccattcagtcattgatagatacttgggctaactttactttttgccccctcttagaatataaggttttatggctcataataatttcatgctgtagcacatcagaatgcctcagcacactattaccctccagttaagagaataattctgagcagtttgagaatatatgtatttttgagacagggtctcactctgtagcccaggttggagtgcagtggcgcaatcttggctcactgcaatctccgcctctctggctcaagtgatgctcccacctcagcctcccaagtagctgggaccacaggtacgtaccaccacgcctagctaatttttttttttttttgtattttttgtagagaccgggtttcaccatgttgcctaggttggtctccaactcctgggctcaagcagtccgctcacctcatcctccaaaagtgcttgagaattcttataccaaatactttgacttgaaaaaccagcaaattttcctttctgcttttgtgaccaagggcagcattttctctcaaagctcttacattgaattttgtctctcaccagactagattatgaatttagagagactagggcagggggtggggtgatatcttcatttgcccagtacctggcactgtgcttggcactgggtggatactgtgtatgtatttgttggaggaggagtgttactttgggcaaggcatgtacctatacctttataattaggaagttgaaccagatgaattctaagaccccttttggttctaacattgtttgggtccatcattaaacctgaaaatcccaggctgggcgcggtggctcacacctgtaatcccagcactttgggaggccgaggtgagcagatcgcttgaggtcaggagtttgagaccagcctggcccacgtggtgaaaccccatccatctctactaaaaatataaaaattagtcaggtgtggtatgcctgtaatcccagctacttgggaggctgaggcaggagaatcacttgaacccaggaggtagaggttgcagtgagctgagatcgcgccactgcactgcagcctgggcgacagagtgagactctgtctaaaaaagtaaaataaaataaaataaaaaataaatctgatgatgaaaatttcagactctctggaatactggagatttgggggaggtagtgaaatttttggatagacatattttcactgcccctcaaatgatacccagaggtggtcacctacaagtaaacccatgtcaggatatagtgtttcttaaaataacattctggatttgggacttcctctttgtgcagtgggtgccattctttgaataataaaaaagctaccatctaaaaagtgattttaagtttagcttaatcgtgtaccacatttcctagatatacacggatagaaaacaaacctcctcttgacataatcatctttataatgaatctcatcggaagtcttaatggtaatcttaccatgagaagaagtcaaagcaatgagcaactgaggaaaatgaaaattctggaattagagaaaaaaatgctgataagaaaggacagatgtgatctgagtactgaatcttgttgattttctgaactttatgctcatttgtacatttttattttaagcctggtttccaaaagtctcttgttagcaaccagatggtcgtcaaataattgatacgggttcattttaagcccatttgaggaacataatggcctgaattttccagtagcagggtttagtaattctgctggtctttgaatgccaacagggttttttggaaattgagttccctaatgtcttggaagtaactcttggaaaataggaaccagtgaattgattgcatgatgtacttggaataaaaagttaaggatatggtttattttggctaaaacgtccacccttagaagtggttaaatttgtaaaattaggtgaggatttttgtgtgtgtgtttaagtttttttttatttgttttctgaggcttgagttaatgaatatgaatagacatttcgaatacactaatctgatatttcccattttcagagatccgttcaaactctagggtctgtgcacgtttttacttacatctgggagctaaaaagtctgagctcagaaacagagtagaattatggttataagaggttgggaagggtacagagagaggagggtagggagaggttgattaagggatacagaattacagctagatgggaggaataagttctagtattctgtggcatcataggctgactataaacaacagtttattgtatattttcaaacagctagaagagaggatttcaaatgtttcaagcacgaacaaatgctcagtgtttgaggtgatggatatgctaattctgatttgatcattatacattgtatatatgtattgaaatagcacatgtaccccataaatatgtacaattattatgtgtcaattaaacaaaacactggggtttgctattctaaagtcttactaaatgcttttcaaagaaagaaaaactccttaaagtgtggtttgcaacgagaaaaagggttgtgagctgcctccagagtcagtgagactcaatggtcattttgttattgtttttgagacagggtctcgctctgtcacctaggctggagagtgcagtggcatgatcacaggtcactgcaacctcgacctcttgggctcaagtgattctcccaccccaaccacctgagtagctgcacagtgcctgtgcacgcgccaccacgctggctgatttttgttgttgttttttttctcttggtagacagggtttcgccatgttgcccaggctggtcttgcactctgggctcaagagatcctcccaccttgtcctctcgaagtgctgggattacaggcatgagccaccgcacctgacctgttatttgaactggagaaaggcatcagcaactgttttgggggtgctagtgagccgcaggttgtattgctggaaacagtgaaagagagagctgaggtctgtctgaaaagcctcatgaactgtcagagcggtgacagagcagctgtgctatggagaggtactcctttcaagtgctcttttagttggtattctcagaatgtcactaggtgtttccagcagaatcccatcttgcgaaacgtgtctgtcctgggctctctgttttggtgtgtgcgtacaaagccttcctttcctctcctctgctcacgccaccatggctagccagtctctggctgtcttgggatctgagtggagctcctggtggaaccagacccagaggcctcattggtggacaggttagttttccttggctaccacaacaaatgaccacaaactgggtggcttaaaacaacagaaatttattctctctgatttctggaagccagaagtccagaatcaatgtgccctccaacggtgttctaggggagaagccatttcttgcctctcccagcttctggtggctcctggctttcctttgcttccagccgcatcactcctctctctgccttcctcttcacattgccttctcctctgtccatcttctcctctgtgtgtctcatatgaggacaacacttgtcattggatttagggacccccaggataatccagaatgatctcttcatctcaggatccttaactacatcagcaaggaccctttccccaaataagatcctgattctgggaattagaatgttgacatatctttttagggggttgccattcaatttaccacagtaggagtagcaattcaggatggggccttgaaaaggaagcagaagaaacagaagccttcataatgtgatagtttaaaaaatctgcctggtcatttaaaaaaatccttcagaaagtaactttattgaggcacattttaaatatcatgtaattcacccatttcaagaatatagctcaatggtttttagtaaacatacccagttatgcaaccatcatcataaaatgctttagaacattttcatcaccccaataacatccacatccttcatgcccatttattgttaattcccattcccactcccagcttcactgcctgctgtctgctgtctctctagatctgccttttctggatgtttcatatgagttgtttttttttttttgtgaccgagtcccactctgtcacccagactagagtacagtggtacaatcatggctcactgcagtctcgacctcctgggctcaagtgatcctcccacctcagccttctgagcagctgggaccacaggtgcatgccactatgcttggctaatttgttgttgttgttgtttagacgggtttcactatgttgcctaggctggtctagaactcttgtacttaagcgatcctcccaccttggcctcccaaagtgctgagattgcagacatgagccaccatgcttggcctaaagttttatttaaaacttaagaaaacatttctgattgtaaaatatggagaaggacaatcccatcacctggagcctgttagaaatgcagaatctgcagtttagcaagatccccaaggcattctctatattagacttagacatactggtacattgtatctgctatattgatcccttgtccacttaatatattatgagcacttccccaaaagtattatatctcttctgagaacattttaaatctcattgtaagaatataccacaatctatttaactagccacttcatggcagacattgtttcccatctttttttgcccttgaaaataaagctgcaataattatctttgtatagaaatatttgtgtatagttttatatctactgtatcagtaattccatttctaggaattgattataagacaataattatagacagactgctaaaatttagaaagtgcatatgtaaatactgatcagtggagtcagtcatttaaagtgctgttttccagcatggtactggtaccaaaacagagatatagatcaatggaacagaacagagccctcagaaataacgccgcatgtctacaactatctgatctttgacaaacctgagaaaaacaagcaatggggaaaggattccctatttaataaatggtgctgggaaaactggctagccatatgtggaaagctgaaaccggatcccttccttacaccttatacaaaaatcaattcaagatggattaaagacttaaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacaacaggtgctggagaagatgtggagaaataggaacacttttacactgttggtgggactgtaaactagttcaactattgtggaagtcagtgtggcgattcctcagggatctagaactggaaataccatcccattactgggtatatacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtcaactattgtaagaacaaaaaaccaaacactgcatattctcactcataggtgggaattgaacaatgagatcacatggacacaggaaggggaatatcacactctggggcctgttgtggggtggggggaggggggagggatagcattgggagatatacctaatgctagatgacgagttagtgggtgcagcgcaccagcatggcacatgtatacatatgtaactagcctgcacaatgtgcacatgtaccctaaaacttaaagtataataaaaaaaaaataaagtgctgttttcctggaaactagacctaaagccaagcagataataggaaatgtgaacccccaatacatgatgttagcacatcttgctaactctcacctccttctcctcctccttttttttttttttttgagacagggtcttgctgtctcacccaggctggagtgcagaggtataatcatggctcactgcagccttgacctcctggggtcaagcaatcctcccacctcagcttcccaagtagctgggactacaggtgcacactatcacacctggctaccttaatttcttttctttatagagacagggttttgtcatattgtccagtctggtctcaaactcctgggctcaagtgatctgcccacctcgccctcccaaaaggttgggattacaggtgtgagccactgcacccagccacctccatctgcttgagcattggtttcattgttgaacaaaatgaatgagcaaataatgaatgaatgagtgaatgacaatggcatcaaaaagtgaagtgtaggttgttactgagcagcggtgaaatagaaaggaacaaaatgctggacccacatgtaatcactttcttatctgttgtaattttatccttactcaatttccaacctccactagtcggttctgcccttgtaaagcagcccaatgtgtcactcctggaagcccctgctgcttcaactatctgtagcacactactcctcataggtggaaagtcagtcatgggagtgacgataccttcctcagatcacacctactggcctttcgattccgttttcccacttttcacaaggattgtagtctcttgaatatttactggccttcctagttctcagatccttgggaagtatgtgaagaggtcgggacttgtgtattcacttcgtatctgcccgattgccaggctccttaggtcaaggaggaattgagtgagttccaaggagagggtaagtctgaattttcccctttttttcttttctttttttttttttttttgagatggagtcttgctctgtctcccaggctagagtgcagttgcacaatttcggctcactgtaacctcagcctcctgggttcaagcaattctcctgcctcagcctcccaagtagctgggattacaggcgcccgccatcgtgtccagctaatttttgtatttttagtagagacagggtttcaccatcttggccaggctggtctcgaactcctgacctcgtgatccacccgccttggcctcccaaagtgctgggattacaggtgtgagccaccgcacccggccgaattttcccctttcattttctgcactgctgtgttctctgagctttccactgctatagtgtttcctgatgagaaggaagtgtttcctccagcttttttttcttcctggaggagtaggatatgaaggaatccctgcccccacacggggtgggatccagccagctgctccagaggatctcggcccctcctgtagcctcaaccttttttgtttctctgggtggtgactctcacaccagagcatacgttagaacctcctggagggcttgctcaaacaccgactgctggaccccaccccatgccttctagttcaatagtctgggctggggccagagagtctgcatttctaacaggttctctggtgatgctgctggtgtggaactccactttgagaactactgctctggcccacccctcattgcccctcttcccctgcaattgcttccaagtaggcagaataaggcgctggaggactggtgtgtttgagacccttgcatctagggagcccgtccagacttctaggggtagcgcctagcagtggtgtgtgcctgttccaccaatgaatgcagctttagacaggcccttcagagtataagaagcagtggctcattcaaattccttcaagtagtgggggtgagaactagggggttaaaaacagagccccaggtccttaaggcttcacaggaactcatccagaaagccagcaggtatgggcaggctggggcctcagcctgccacatgcctttgtgtttcagctggcccaaggctgtactgaacattataacctttcagccctggccctttctgttgacttcctctcctctcctcttggtgggattttcccctgtatttagggcagggcagtttcttctggaaggatccctttggctccaggctctgtgtctaaccctcccacttgaccctgtagcacacagccctggccagttgctggtggaagctgcagtccttagtgaaatggggagtggactgtggttcctcaaattgcattgtcatttggaggctcaagggcataccttttttatcctcaaaggcttaaagacaactgatggcagctggagagggttaagggagatggaggaaatcttcattcaagtttgtcttgctcagtgatcttttaatgtgtctttccagtcttggggtggttgtgtggtctttcagtacagattcaggtggcaggcggttggtggtttggtttaaatcagaggtatgttaaaatattcaggatggtgagggtgtctgtgaaaactaagagaggaagtggcttaaagagctaggctgtcagctgggtgcagtggctcacacctgtcatcctggtgctttgggaggctgaggcaggaggatcacttgaggccaggagtttgagaccatcctgggaaacgtagcaagaccttgtctctacaaaaaattaaaaagaaaaaattagctggacatggtggtgtgcgcttgtggtcccagttactcagtaggctgaggtgggaggatcacttgagcccaggagtttgagattacaatgagttatgatcatgccactgaattccagctttggtgacagagtgagaccctgtctctctctaaaaaaaaaaaaaaaaaaaaaaaaaaaaccaggttgtcaagctagatttagaattctttttttaaaaaaaattcttttattttttccatgggattctgcttgatatagacttaattctgttgtctgttggcccagggacatcactgcccagtggatacctcatccactcccactctttttgagggttttctccagggagttgaatctgtgaggcagtctttccctcctgctttcatttctcccccagcatcttctcttaggccctgctaggccacttgagcaagaatctcaggccataaaacatttccacatcagatttcctccaacagcacagggcgcttatggctcacatgtggaagcgtggacattgacatgttattttgagacttctgactttagagcattttgaggaaagtatcttctgaggtctttctttcctgtaagctagctgtagtagccaattccttttgggggatgggggaatgaattcttggcacactctgttgtcctttgggctagtcacatttgtgctaaatatcaggcgagctccctgcggacaccatgggatgaggacaacatcttattcttggcaatttgcaagggacaaattaggctgtggtacttgcaagtagaattattaaatatcaatgggggataataaatgtgaagtagcttgcaaatcttctgatattatggctgtttcagtgaaaacacagctgctaagatactttcctagctgtaatcgagaaggtaattttcctgaaaggccatttaaagcagatctttagtgcctttggctcattaagaagcatgaataggggtaagtctctgaaaaagatgaattagacacagagcagaggagcggtggtgtccatgatgcaggatgatggtgtccagggcctgcgtactccaaatagaccaaggactaattagttgtgtggtttattaatggactggagtcaatcctggactaatacaactaattcttccatttagagttaatgttggcactcaattttccctggtaatgagtgagttagagtaagcaggcacgtgagtgtaagatacagtgctaatattttgtgagaaacattgaacgaggcttgatgtttaaatcaatagttgaaaatgtgggggaagactttccagaaaaggcttacaggctaaataagagcagttaattgaaagcaaaccaagcccacccaatatttagatttgtttagaaaccaagtgaacatttgagatgagaaacatttctctagttctgtgatgtcgtcggctttcctggtgtgtttggagcttttgacattggtgtggtactttacctcagtgaggctgatggaacagagtggatgttacagggcctcaatttcagaattcttgttgtgtactcgtgaagacctgtggagagattttgcctcaagtcagtttggatggtttctgccctccagtctgataaagtcccctgatgtcaaaccacaggtggaatttccagagactgtgatctgtggactggtgacaaatcctttgtgaaaagtctgtgtgacactactaaacagagagggcttgggggaggagaatgaggggaccaatgcgctcccctcagaagccttgatgctctcatagaaggtctggccaggtgtgggggtctagctttgtaaagtaggaagacccctttgatgattactttttttgtctagttaaacctttttggatttctctgtaatttaaagaatataatttttaaaatgtaaagctgaggattcatttttctatgtgttaataaagttaataaaccccccatatttattggggaaggcagtataaactagaatttccttaggtttcttctttctttctttctttctttctttctttctttctttctttctttctttctttctttttttttgagacaggggagtgcagtggcgtgaactcggctcactgtaagctccgcctcctgggttcacgccattctcctgcctcagcctcctgagtagctgggactcctggcgcctgccaccacgcctggctaattttttgtatttttagtagagacggggtttcaccgtgttagccaggatggtctcgatctcctgacctcgtgatccgcccgcctcagcctcccaaagtgctgggattaaaggtgtgagccaccgcgcccggcggcttaggtttcttaaaagttaaccaagtgagcatcactgaagattaaccaaaggatctatgcaaagatgtatttttattttgctcaaacagttgtttataaaaggtaagatgaaaaccaaagcacacattacagagtaggaaatcaagtacttttatttcataccagaaataggaggaaaaggataaaatcagggtgaagccctaaaaaaaagacagtcaaaaaagaccctataggagggctgggagagtttttgagccatgaggaccatttgaccttggtgacagggcagctactgagttcccagaattctgccttttcaagccatgtaacatttgcaaatgctgacaaacagctgctaattccgttttctatgaaagggtgacagggtgttctcaggacatgagcttcttctccccagagccacatgcctttcacacagtgacagtggcaccatcagtgaggacctgggaaggagacaccagtccagaaaaatgatgattcttttttttttttttttttttttttttttttcgagccggagtctcgctctgtcgcccaggctggggtgcagtggtgagatcttggctcactgcaagctccgcctcccgggttcacgccattctcctgcctcagcctcccaagtagctgggactacaggcgcccaccatcacgcctggctaattttttgtatttttagtagagatggggtttcactgtgttagccaggatgatctcagtctcctgaccttgtgatccgcctgtctcagcctcccaaagtgttgggatgacaggcgtgagccgctgcgcctggctgaaaatgatgattcttataggggggtgtgtgtgtgtctgtgtgtgcatgcacgtgtgtgtgtgtgtgtgtgtgtgtgtgtttgtgtgtgtgagagagagagagagacagagactgaattgcttgagaaaatttgcatttgagttcagaagtatgagcccacatctgtgaaagcagtaggtaagagactagtgaatgcagatgactcagatatgcacacaaacctgtggatttacggttttagaaaatacaaatatacattgtgctaaatttgaataatttgaagtgaggtacaattccaaagagcaagttgtgatctaggacaaaggaacctctgggatgagtgacagctcggagagccagaggtggaaggaggaatgaaacacagctactaaggctacctgtgtcatgggccaccctggaggctgggagatctcttcttatgggtttctctcctatttgtgtctgtgtgcctatctgtattctctatgtgagtctctatgcttgtgcatcagtgtctctgtgtatgggggttctgtttttctgtgtctatgggtctgcctctcccactcgctgtaaacgggctaccccagaaacacttgccagatggagcacactggcctgggtcaatgccacatatggtttcttacaagttgcagaaaggttacacttagcaaaaatgggtgtgccccaaagccccacacagtgaacaggttttctcatgatcttgtcacacctgtcacaagagtgggggaagatgaggaggaagagccagctggaagttttagaatcgtgtttaatttgtggtttacatcctcctcccgacccttttccctgacaaaccacccacacacttttcactttgcattacatttgtcctcgcccatctccatgggatattcctagaattctgaatgcttcctttgactttctctactgcagaaactcttctccctgggaatgatttttacagctccagttaattttcatgttcaatgttggaacggagaggaaatggggggagcatgggtggtgactcaggaagctgaggaaatcgcccttattaggcctcgaattttcttctaaaaaaaaacaaaaaacaaaaactggccccaggctgtttgggccttatttttttctgattgctagctttcatttgacctccctccttccatttctttctctctttggttctgctttgaaggtcacaaagcttcccaaagctgttaaaggtggtgctaactccctttactgaaagattactcttcagctgtaccagtggatttcccctaacagcgctcccagaagatgaacagactctcttattgttggtaataactgagtttttaaagaggacaccatcattggcaataatttaaatgacttttctaaggtattttcccaactgtttttctctttttcctcttccacttgagcaaatgtcatgaatttccttttttttaaaccaccaacacaagtattttttttcttaaataatgtgtatacttaaaatttgtaaaatgcaggcaggaaccagaaagataattcattttctagccagtcgtttgttgtaagcctgatatgtgtttgttatttttctacaaaaatggaatcatatggtaggtggtgttttataagaagtttttttttttgttttaattgtggtgaaatacacaacagaaaattgtaaccaattttttttttttttttttgagacggagtttcgcttttgtcgcccaggcaggagtgccatggcagaatctcagctcactgcaacctttgcctcctgggttcaagcaattctcctgcctcagcctcctgagtagctgggattactggtgcgcaccaccatgcctggctaatttctgtagttttagtagagatgggatttcaccatgttggccaggctgatcttgaactcctggcctcaggcgatctgcccgctttggccccccaaagtgctggaattacaggcatgagccaccgtgcccagctgtaaccaatttttaagtgtaatactaagttacttaattttctacaacatcagtaatgtttttcaagttttttaaagttgcagaaccctttcctcaaagaccagagagcttcaagcagagctgcaccaccattgaggcaggagtggggagcccaggctatatcttgtcaatgttgcagtttacggttaccctccccatagctttgaggcctcctagggatcctggtcacactcagtagccaactttgaaagcacatagacctaccttatactgccccaattgttaatagcttagattgctctaattttcttataaagaaaaaattttggacatactttaaatcctctttgaagcacatctgtgattacttccctagataagtccttataagtagagttactgggtttagaatatgagcggtgttgttgtttttttctttttggcctataatccatattgccaactggtcttcaccaaagtgtgccacatcagactctcacagtaatgtaggagaaggctcaaccccccattccctgggtaaaataaaccttaaaaattcagtatgttagcaaaagaaattatcaacagggtaaacagacaacctacagaatgagagaaaatatttgcaaactattcacctgacaaaggtctaatattcagcacgtgtaaggaacttaaatttacaagaaaagccattaaaaagtgggcaaaggacatgaacagacactttttaaaagaagacctgcatgtgaccaacaagaatatgaaaaaaagctcaatatcgttgatcattagggaaatgcatatcaaaaccacagtgaggtaccatctcacaccagtcagaatggctattattaaaaagtaaaaaaaaaaaaaataacatgctggtaaggttacagagaaaagggaacacttatacactcttggtgggaatgtaaattagttcaaccactgtggaaagcagtgtggcaattcctcaaagagctaaaaacagaactaccattcgacccagcagtcccattactgggtatatacccgaaggaatataagtcattctaccataaagacacacgcacaagtatgttcattgccacactcttcacaatagcaaaaacatgaaatcagcctaaatgcccattagtgatagattggataaagaaaatatggtatatatacaccatggaatactatgcagccataaaaaagaatgagatcatgtcttttgtgggaacacggatggagctggaggccattatccttagcagactaacacaggaacagaaaaccaaataccgcatgttctcacttataagtgggagctaaaggatgagaacacatggacacaagggaacagacatgggggcctacttaagggtagagggtggaaggagggagaagagcagaaaaaataactattgagtactaggcttggtacctggatgacgaaataatctgtacaacaaaccctcatgacactagtttacctatataacaaacctgcacttagtgacattattttcgtatgtctgttggccatatatggttcttctttgaactatttattcataacctttgcccatttttagattcagatgtttgtccatgaatccgagagtgagaacccttggttatactgtgtgtagacattttaagcgatattttcaagaatcagctgtgacacaaaaggagtgggggattgtgggccaaaagtcttacagtcagagtttagcatgagaacttggaaagaataaacttctggactttgatctctgattttatgattctgtgatactagatgacttatctgccatttaggaaggttctgtcatattgactagagagaaaatccggagttaaaaccaatggctgcattaagttagattttttttagcagtctgattaatctttactgctccagtactcaaactgcaacgtgagagttcaatcttgtggcttattacaaccacacattgtattaaacatcttctacttgagaaaaacatgaagtgccccatgtgcattttgagtatgttatatcatgagtaaagtcatggctggaaggtagttaagacagaatttctttttgtttgtttggcaagtgatgctaaatcaacaataatattgctttgaaaaggagcaaaattatgccatgactatttgcaatgaaaataaattataaggcctggtgtggtggctcacacctgtaatcccagcactttgggaggccaaactgggtggattgcttgagtccaggagttcaagaccagcctgggcaacttggcgagaccctgtctctacgaaaaaaaaagaaaaagaagaaaaagacaaaaattagccgggcatggtggtgcatgcctgtagtcccagctactcagaaggctgagatgggaggactgcttgagcctgggaggtggaggttgcagtgagctgagatcgagccactgctctgtactctagcctgagtgacagagctagaccctgtctcaaaaaaaaaaaaaaaaaaaaaattataacgcagctgtataataatattgctcaatatgctattataaagtgaaaacctccttctgcttaacaggaggtgtctctatttcaggacaggacactttacatggaataagaacaaagatcttactaatttaaaaaaaaaaacccaaatgtgtgtgtgtgtgtacactgaatttggccagacaggaaaacaagattaaaatgtcagttctgtcttttcaacctgaatgcctccaacagctacattttagaaatttctgaaataattaatgtgtactcatatgttcacccataaatcagaccatgggattactgatgaaaggatgcaaacttgggggtcagtcttggaaaattttgactgaattttaatcttcctattgtgaacatctatttcatgttgaaaactcagcatttcctgtttctcctaaacatagacaccacaataaatagtttgtatctatttcttttccttcaaaaagatcacagttctttgcctgtattatctagctccaagataaattaaatgccagctgaaattgtttggtgtatctaggatgcccatggtatgtgccatttggttgtgtggctgagtcagtggcgttaggtggagtttagcctccccctgagtggttattagggttgtggatggaatgtattgaattcaaatctctcatttataaggcgaggtgtgaattgtagaatgatccgattaacttgggctgaaccccagatattgctgtgtgctttttttcccccttcaacatgtcatggaggcttaaaacagtcacccacacgccctttccatatttaaccttttggaggtgctgtcttattgctgagccagggtggtaatagctgactggcttaaatggacagacagcaacaagatagctgaggagggtaatagatcctgccattctgttcatctgcgtttgtgtctgggtaaaattctcattaagttgcagccagtgtgtgtattttgtgtgtctgtgcattgtgtttgcagtccattagaaaactgatacccatgtggtgccttggtattgacaggtttcctgtgtgtgacctaaaaccattctgcattttcatttgtcaggttttcccgtgtgctctgggttcagagcaaattaacttccaagtcaacagaaccaccgaagttctgcttgaactaaagctaagctactctactggtgtggggggagggaggatgttgatcattagaggacaagggcaagttgagaaattgttctatatttcagccagttaattatcgcagcttcccagcatgtctgcaaggagaaatgagaagaacatcaataagtgattattttctttcattattctgttcacctgccatttactgtgcacgttccaggggaagggagattagcaggggttaactttaaaaaatcagagtcccagaggactcacaaaggcatgctgtgtctgcctttctggtactgagtgatgagggtgggacagggctggtgctaaacttttggatctatttttaagctttcaggacaaattttataaatacgagctgcttctttaaaaaaaaatccctttctactctaaaaatagtttgctgggaaaaagtttgtgaattgtttattaagactcagaaattcagctgagcatgtttccttataaataaagaaaatcacctcacagctactgtcaaaaagcagatgtggcttcttaggaaagaaacaagatttctgggatgttaatgccaatgtcagaatgtgggagaaaatttggaattttccctcctggcttgctcttttcagaccttctaaattctactcatttcttatgatcaagttggtgtcttgtcccttttggaaagagttttcccaggcagaatgaatggccttagcttctgttcttaccagtacccttagccacacctgtctcttttcctataacactttgttttatgttaatgacaattgctaatatttactgtatgccaggcactgttctaagctcagttcatgtgctattttattttgttgtcataactctttgaattagatactactattctcattttaaggataaggactatggtaggcagaataatggcccctcaaaggtgtccacgttctaatcttcagaacctgtgagtgtttaccttacgatgcagatatggttaaggattttggattagaatcacaagggtccttataagagggaagcacatgggcaacaaaagcaaaaatacataaattagacaacatcaaaatgtaaaacttccgtacatcaaaagatacaatcggaccaggcgtggtggctcatgcctgtaatcccagcactttgggaggccgaggcgggtggatcacgaggtaaggaggtcgagaccatggtgaaaccccatctctactaaaaatacaaaaaattagccaggcctggtggcgggcacctgtagtcccagctactcgggaggctgaggcaggagaatggtgtaaactgggaggcggagcttgcggtgagccgagattgtgccactgcactccagcctgggcgacggagcaagactctgtctcaaaaaaaaaaaaaaaaaaaaaaaaaaaaaaaaaaaaaaagatgcaatcaacagactcaaagtgcaatctgaacaatggagaaaatattttcaaatcatatatctgataaggggttaatatccagaatctataaagaactcctacaactcaacaacaaaacaaataacccaattcaaaatgggcaagggacttgaatagacagttttccaaagaagacataccaatgaccaacaagcagatgaaaagatgctcaacatcactgaccatcagggaaatgcaaatcaaaatcacagtgagattgcacctcatacccattaggatggctgctataaaaaaagaaaaaacaacaagtgttggtgaggatgtggaacaattgaaacctttatatactgtcggtggggatgtaaaatggtgtagctaccataaaaaacaatgtggcagttccttgaacaattaaaaatagaattaccatatgatctagcaattttacttctgggtatatatccaaaagaattgaaagcagggtctcagagatattatacacccatgtgcacagtagtattcacagaaggcaaaaggtggaagcaacccaagtgtctatacaacagaatatcattctgcctcaaaagaaggaaattctgacacatgctacaatgcggttgaaccttgatacattatgctaagtgacagaagccagtcacaaaaggacaaatactgtatgacttaacctatatgaggtatctaaagtcaactttacagagacagaaaatggactgctggttgccaggagctggtgggaggggagaaaggagttgtttaatgggtacagagcttctttttcagttttgcaagaggaaaagaaatctgatgatcttttgcacaatgtgactgtacttaacactactgaactgtgtagtttaaacctgttaagatgttaaattttatgtaacgtgtatttaccacaattaaaaaaaattttttttaaaaagggaggcagtaagatcagagttagtgatgatagaagcagaggtcagagagagagcgagcattgaagatgctatactgctggcctcgaagatggaggaagggaatacaagctaaggaatgcaggtaacccctagaggctggaaagggtgggagaacctcctctcctacagcccctgaatgaatgcagcctgccaacacctccattttagcccagtaagacagtttctggatttctaacctccagaactgtgagatactaactttgggttaagtcgccaagtttttggtaatctgttagagcagtggtaagaaactattactaaggactattcagttcagagaggttaggaccttgtgcatggtcacgaagtgactggaactctgattaagagctggagctggccaggcaggatggctcacacctgtaatcccagcactttggaaggccaaggtgggcggatcacttgaggtcaggagttggagaccagcctggccaacatggtgaaaccccgtctctacttaaaaaaaaaaaaaaaaaaaaaaaaaaaagaactgcaaaaattagctgggcatggtggcacagcctgtagttccagctattcaggaggctgaggcagaagaatcgcttgaacccgggaggcagaggttgctgtgagccaagatcgcaccactgcactccagcctggcaacagagcaagactcagtctaaaaaaaaaaaaaagagttggagcgcatgtccactccactcagagttccagccttcctagatggtgagaccctaggtagcagtggccatctttaacactacccccgacataggacttgatatatattaaggcacttagtaattgtggctaaaagatttaatgataatgcaccatcgccttttattctgttcccctgatgctgtgtcctagaagccatagggttaaacctaggaaaaggctttttagaaaacgtttcccttccctgtcattgtggggctgctaaggaatagtgtcctcaaggttttagtgtcacttctgggggcctctgggtatttgttgccaggtcccatgatggagtagagtcaggagtgcttatagaatccagacaggggtcagagtcaggggaaatttggatcctgttcttggtagatgggcagtctgttttgagaagaaatgaccaaatttagtcatgacctgttaacctgtttattaacattatttctctttaagctaaataaacgcagatatttctaagcacaaatgaagaaatttctgtgttagctctgatcagtgggcatttcccactctgaaatgcttcctcacccccaaacctaagctttggaaaccaggctcctaaaatcagggccttgtaattccccatgtgagttattctaaattgggcttctgggtgtttctttttttgaagtggggagcaggtgggaaatgagaggccttctaataatgtgcattaacttttgccataaaattattagaaaaaatgggtattttgtactttttttttttttttttttttgagacagagtcttgctctgtcacccaggctggaatgcagtgggcaattgtagttcactgcaacctccacctcctgggctcaggtggtcctcctgcctcctgagtagctaggactacaggtgcatgccactgtgtccagctagtttttgtgttttttgtgtagacggggtttcaccatgttacccaggctggtctcgaactccgtacctcaagagatctgcccaccttggcctcccaaagtgctgggattacaggcatgagccaccgtgcccggcctactttgtacttttaaaataatctttgagtgggaaggcctttgcaatcatgtcacaaatctgaaagacctaagggaaaagattgattgattttactacatagaaattagagacttctgtatggacagagatagaattaatagaataaacagacaaatgacaaacaggtaaattctgcaacacatatgacagccccaggggcacttcttttatatacagagagctattagaaatgagagggaaaagcaggatgctatgtaggagaattgacaaaagacatgagtaagctcatcacagaaaaagacaagtggataacggtaagcatatggaaagctgttcaaccttattttttactaattaaagaaatgcaaattaaatatcatctcctgttatcagattggcaaaaatgaagacatttaaaaatagtatggggaaatcagctctcttccatgctattggtgggagtgtaattgataaattttttggaggccagttttttattatctgctaaaagtaaggatgcaccaagttgttgacccagaaatttcactctagggaatttgtccctcagttgcctttgtggtatatgtgcagagttatgggcacagtgatgctcaatgtagtgttgtttgtaatcgcagaggacttgagacaactgggtggtttcatgtgggttatagttctgtgagaagagaactatctcctacccagcaagattcaaataagttacccgtttaaccagccaaggatacagaaatttagaaaggagattgcctcaggcaggagcgtatgaggtatatataaaaggtatatcccagataccaatctccactcgcaggtttccagtggtctaaatggcaagggagattttgccagatctcagaaacagccaaagtttgctgtgccacaaatcttttttccatgagcatttcagaagagccaatgaggacaactgttgtgccttcatctgtggtatggtgacaaataacgcagctcacctgattcaccttgcctgctgcctagacagagccgatttatcaagacaggggaattgcagtggagaaagagtaattcctgcagagctggctgtgtgggagaccagagttttattattactcaaggaattggaatttttaaagataatttggcaggtagggcttgggaagtgggtagtgctgattcaggtcaggttggagatggaatcatagtgggggtcaaagttaggtttccttgctatcttatgttcctgggtgggatcgcacaactggttgagccagtttaccagtctggatggtgtcagctgatctagtagagggtctgcaaaatacctcaagcactgatcttaggttttacagtagtgatgttatccccaggagcaatttggggaggttcagactcttgccaggagctgcatgacccctaaactgtaatttctaatcttgcagctaatttcttagccctccaaaggcatactggtccccaggcaagaagagggtcttttctggaaagggctattatcaattttgttttacagtcaaaccgtaaactaaattcttttccaaggttagttcggcctacgcccaggaacgaacagggacagcttaaaggttagaagcaagatggagtcggttaggtctgatctctttcattgtcataatttcctcagttttaattttcgcaaaggcagtttcacttccgtgttccaaaatctactttcagacacaaccagactgtcccttttgatactggtctatcctacagttggattctgtgcagctatgaggaagaggggcaaagctctgatggagaagttgtctaagatgcattgttaagttgaagaaagcaagttgcagtatagcacacatagtaagagtccatttgtgtcctcttgttatgtattttttggaatgaacatgtatacctttaattattaatttttgagtggttacccacacacagttttgaaagtcatatgctgctaaaagatgtgtgagtacccagcagcctcttgtcccttctctttgtgtccttatattctaggaggcagtcgttcttcagttctagctgttgcttctactatttgctgctgtgcttctgaataatattcattgctgctctcttggtttgtcgattctagatatgatctcttaactatcatggtagttgaggacttcagcttttctctatatgcacatatctcaggttttgctttaatctatacttaatgttttcattaatgtagcaatgttgatattgaatattgaagcaagaatatactataattaacttacgtatatagctttatttctctctctccctcctttcctccctctctccccatctccctctctccctctctctcccccctccctccccactctctcccttctctctctatccctctctctctctgtccttccttcctcttcgtccctccctctctctctttctctctcccctacttcctctcttctctctctctctccctccctctctcaccaccatctccctctccctccctctctctcttccccccctccctcctccttgttttcttctcccccctcccctcccccctctctacctctctccttctccctctcctggaaaaacaccagagccttccaacctcctgttccactctgctgcccagctgtcagccaggaaattcccatcacacctccgccgcctcctctctctcattgactgtcctggatcttgcgtccttctctttcttgttttactcatttgacttgatggaatgcaccctccagtagccttctgagggagccagtgcacggcttcaagtaaattttttgaaacttcttcaaaaccaaccacactaggagttgcatactaaaaagtttttccttttagcattcaaccatcccttcttagcccctggcccatgtctgttggcaggtggggttctccctcctactgatggagccagagaatcctgggacccagaggctgtgccattattcacaagatcttatttaatcttcagaatggtttgataaactaacaaaactgaggcaccaaggttacgctctcagtggtatcagaaccaggaattgaagtgtcagctgcttgggccaggctgatgcctttcctaatctagctgctccttactggaagaaggaataacagtaccatgccccaagtgacacatgccagatgcatgtaaccatggttacagggtgagtccaattctcggtgcccacttgtgtctggttcctgacaacttcagctctagatagccatccttctctctagaagtaccttccagtatgtatgtatgtatgtatgtatgtatgtatgtatgtatgtatgtatgtatttatttattttgagacagaatctcactctgttgcccaggctggagtgcagtggtgcgatctcagctcactgcaagctctgtctcccgtgttcatgccattcttctgcctcagcctcccgagtagctggaactacaggcgcctgccaccgcgcctggcttattttttgtatttttagtagagacaaggtttcactgtgttagccaggatagtctcaatctcctgaccttgtgatccacctgcctcggcctcccaaagtgctgggattacagatgtgagccaccgcgcccagccaagtgtgtgtgtgtgtgtgtcgagagagagagagagagagagagagagagagagagagagagagggagagagagagagagaggagagagagagagaccgagactgatttatagttatggtcctagctccttatggtaattaaaatgccctgcctatgatttgtgtaaacttggtgtgattatttttattgctacagtatttggttttaagcaatgtaagaatgtcacccccctcctcccattccttttgtgatgtgaaatgcttcattacttaggaatttgctgctgattgtacagtttagcatttgatctttttgttaaccacagtcaggtgaccacacatagggtaattagattaacccacccctcctcttctccactgaaacaatgtaaaatccaatattctattagcacatgccttccgtagattaatgatcttggagttgctgcgtggaaatttgcatagctccctacagctctaagaaatgaaaatgcccagctgtctaaaagctttaatcaggaaatgagcatgaaatggcattgttttgtcacgggcttggaataatttattcttgacaatcgagttatcctggatataaatgtgtataaacattctttcaacaaccagtaaacaggtgcttttttgttcgttaaaaagtcaagattttcttgacttgggcttggctttgaaatcgttggccctcgtgctggtcactgccaaaagtttatactaaagtcattttccttgtccctcctgttttaaatggcagtttctggaggctggcctttcagagcaagaacggtcttagggagtgaaggaatggggacatggccataggaccacacggggtcattcctcacccagccccttcttgcctgtgttttcatcccctcttgggacctactttcccctatctgtcaaatacaaataataatggcccctatctcttaatgtggttgtgagcattaaatgtgttatcccatgtaaagccttagaaaagtaccttgttcatggtatattcttcataatggcgagctaattccataagacatagggaaatgaagatgcaattctgtttctttttctatttaaaatatcctagtgcacttaaatttttttctgttagactattagtcttggaagcaattgtgactataaatgctttcatttatgttggcacaccgttaaaagaatgatagaactaatgataatggctaacattcattgaatgcctgggagtgaaagactgaatgaggcctattcctgactcttggggctagacataaggacccatgcttatagcccaggggtgtgtgacaggctcttactcatcatcaaagctgttaaaaagacagcagaaacggcccttggaccttggatgttgcttcctctttttttctcctccaagagcaagctttttatctagcacgtgatttaacagttcctgtgttgggggtactgtttcatggactaggtatgatgtagtgagaaacattttaaaatttttccagaggagactttgatgggaaaaatgcccatccctcaggggactcaatttgagatcgtgtaattaaccttttggagcataattagccaaactgtttagctctttttacttgtactctgggcaccaaagaaagctggatcctacccatgataaaactatcatcaataagatttaatgttgcctctttatatgcattttatttttcttgattgtcatgcccttagttattcttgcatttcaagaatctttttttttttttttttttttttttgaaacgaagtctcactctgtggcccaggccggagttcagtggtgcgatatcagttcactgcaacctccgcttccagggttcaagcgattctcctgcctcagcctcccgagtagctgggattacaggcacgtgccaccacacctggctactttttttgtatttttagtagaggcggagtttcaccatgttggccaggctggtctcgaactcctgccctcaggtgatccgcccaccttggcctctcagagtgctgggattacaggtgtgagccactgcccccggccttgaatcttgaactttatatcacatgactgaaaaaaaaacattgattattgggttttgcctgattttccccacatcttagctttcctgtctcccctgcttaatgaaacgtatggactggagagctttctgtaaatcttttgtgtatgttagcatacactgttggatctttaaaatcagtagtggaaattatatagctaaactcttattggggggcagtgtcaacttcttccttgtgtcaatcaagaaaaatgatgagacaagtctcaatcattttaggaagtttatttgccaaagttaaggacgcacgcccgggagacaggtgctatgcctttctctgaagatgattttgagggctccaaatttaaaggcgaaagggtgggatattgagaagtatacaattttcacataagaggcgggtagggaaaaatagttattcatgtctttgtctggctcggtgaatctgcttttttttttttttttgacataagataatatagacaaatggggcagaggaaaaatgcagggaatctgtgtttttacataagataacatagacaaaatggggcaggagaacagtcagatatgcatttgtgtctggtgagcaggggacaactgcacctgtaaagataagctatcaatttacattgccatggtgaaatcttaagagaaacaccttagggtaaagaccttggagctcactaggaatttccttgtgggtaaaatatggggtaggcatgtagtttttcatcttgtagccattgtattcaggaaccaaaaggggaggcaggtttgcgtgacccagttcccagcttgactttttcctttagcttagtgattttgggaccccaggatttattttccgttcacacttgtttgcaaaaaaaaaaaaaaaaaaaagcagtcaataatttaacgatcaggaaatagtaaacatatttcaattactcaatgtttaagttaattaaaattttgaatagctaacacaggcatatggtgccagctaaaagggacaaaatatatgctttctctgtccctcggccacctggttcccctccctggaggcagcctcagttatcagtttattgtgtgtggcttctgtattacacacagaggcgtacatacaaatgtacacaaatgctagcatacgttaggctttttttttttttttttaacctagcaacatgtcttggtgattgtctttcttggtacatacagactgacttcagtcttggagagagttgcatgggattgatttatggccattcatcagctgctctctactgatacacatttatgttctttcagtcttttgctaatttaagcaatggcataacgattaatcttgtacatatgctgttttgcacgtgtatatttgtagtttaaattcctaggagtagaaatactgagtcaaaaggcacagacatttaaatttttgatagacagttgtcaagttgcttcccacagaggctgtacaaatttatttatcaatttatactctacttagaaagtatgtgaggctctctttccctacacccttgctgacattatcaatttttttaattgttgacaatctgacagataaaaatatctcattgtaatttaaaaattaggtacatccctccctaaactgtcaaattctggagagatttgttcttggggtcctcatagcccccattctttgagaggaccagctgtgtgccaggcactacgtcacatgctgtgaaaacaaacagtattctgagagagccagattctagtgcgaggacacatgtaaacattattataatatagtatgtaatatatactatagtataatatagtatgtaaatgctacaattctaggtatgagaaaatagccggaatgatacagggtccttctgtgtactgagcactgtcaggcactgttgtacaggaataccactgtaattttcatttctcttgttgtaccaggacaagccgcagacaaaactcctcagacaccgagttaaagaaggaagtggtttattcggccaggagcatcggcaagactcctgtctcaagagccgagctccctgagtgagcaatttctgtcccttttaagggctcacaactctaagggggtctgcgtgagagggtcatgatcgatttgagcaagcagggggtacgtgactggggactgcatgcagcggtaatcagaacgaaacagaacaggacagggatttttacaatgcctttttatacaatgtctggaatctatagataacataaccggttaggtcaggggttgatctttaactaccaggcttaggtcaggcaggcccaggcctagtttcaggtctggttcctaggcgccaggctacctgcctttagtttcgcttctctttctttttctgagtataaaacagtataaaacaatatgagacgttctgtctctcttctctcatcgtgaatgcagttaagcatcttgttgcatgtttgagtcatttttttcttttttatgtgacctgtcctttgctatttttttgttgggttattgatcttttgctgatactttgtagaaggagctctctttatagaagaggcaacattcccccagtttgtcttttgtcttcgttgatgaattttgtcgttgttgttgtttgctatgttatattcttagttttctgtaatttatttttatttatttatttattttgagacagagtctcgccctgtcgcccaggctggagtccgatggcgcaatcttggctcattgcaacctccgcctcctgggttcaagcgatgctcctgcctctgcctcctaagtagctgggattacaggcacacgccaccacaccctgataattttttgtatctttagtagaggcagggtttcaccatgttggccaggctggtctcaaactcctgacctcgtgatccgcctgcctggcctcccaaagtgctgggattacagacgtgagccaccgtgcctgccattctgtaatttattgaccctttcttttctagcttctaaattctgtgtcagagtgttaaattatctttgcctttctgagattgtagaaacattctttattttcttctagtgctttaaaggtttagtttttaaatgagtaaattcattttgaatgtctaatattcccagttaaataaagaaataagtattacttgtttttttaaaaaagttagggactacatgaattttcttactgtatcatcttctcccctctgctcctaagcctgatctgcatcttttaaggtgagaagttgatggtgatccagccgtatctttatagggatgatacagatctccatgttgttgcagctttgggctcaattgagaatattctgcctctgatcacttgaggtcaggaattcgagaccagcctggtcaacatggtgaaactgggtctttactaaaaatacaaaaattagctggatgttggtggtgggtgcctgtaatcccagctactaggcagactgagacaggagaatcgcttgaacccaagaggcagaggttatgacagagcaagactcctccctacgccccaccaaaagaaagaaaatactctacttcatctgtagacagccatcttgcccataacactctactaaattggtcattcatctgatagatatttttaagtatccaaacaactggttgatattgacaccctttgatccagtggtaataatctagatgtttagcggggtgtgggcaaacataaaggcaccaactgtcatgcaagtaattacactgtacatcgggaagcaacattatctctttgggacacaaaggtagtcgttctcatttttgtccagtatctgttacttgttgtggtctttatagtgttcatccctttcctgaaggtcaagagcttcttgcccttgttctcatgttcttgttattttcttattcgtgttatgagtgattcttgggagataatactgcaagtatatgatattgcaaatatgcagttaaagattgacatagaacatggtaatagacctgttacatttcttgaaatttccttgttagctttgagctgaaaataccatcagaatatttatgagtatatatcaaagcacttttctgagcatcagcatattttgtaagtatgagaaagccattgtggtgtgagacatcaacgtggttctgctatgtaattttagggcaaattatgaaatatgtaaagcatataacaaatacctatgtgcccatcacccttgctttattaaatcctcatattttgccatatttactttatgttttttttcttctttacagttctaatgaagttggtgcacttggtggtttgatagcatgggtattttcttttattgtggtaatcagatatattttttaaagaaacagaatcttaaagctacagctgaagctccccttggtagtctgccatattctcagaatacttgctgtgtcttcccaggtgttctgagacagaccagccttttgtgaagagagccaaatactgggaaggcacagtctctgcacgaagggaacatactcacggggcagctgttcctcagacttgccttttgcgtggggtggggtggggtcaggggagagatatgcatgttggggaacaatgtgctattctaggtttctgtgtctattcaaagctgtcttgatcagtagacttggtaaaagtgtttgtttttagtgatttttaaaaatctcctgccagtggtaattttgcaaaatggttttctatgaactagtgcagggggcacagctgtgatcctgcagccacgtctgggtctaaaggaagcctttcctgcagaaagcaatagagcaggactgagggcaggctgatgaatgatgtctgtttcccctgccctgcttccaccctaagccaagggggctctgcccaacctcactcagctcttcaaatgcagagagaagtaccaggaccagcattctgggcagatcagggtggtgcccagctttccctggtgtccgtggcaccagcctgctctgtgtgccaatactgttggtgacaggagagagagaaatctggcaagatagggggaaaacagctgaggtggagaacaaggatgccctcttgggaacagatccattcatctgattgggtaggtgagatgagacacgcatggctcacctactccatagggtgcatctggcacattccgaccacctgccccattgatgttgatcccagaaaacatctcaccacctgagatgaacattaaaatacccaagcactagctttgtgtatgtctgacctcctaggagaaaatatcagcacatttcaatttaaaagaatctgtcttctttcagtttaagcatttgtgctgttcttttaaattgaaattgcatgcagtgaagtgcagaggtcttagaagtacagttcaatgaatattttggtctatgtacacctgtgtaaccaccacccagacctcgttataggacattttcatcctcccaggagactccctggtacacctccccaagtgtaactgctgttctgagatctctcaccaatgattaattttgcctgttgttgggtttcacataattggaatcatacagtacatcatcttttatgtctggcttctgtcattcaacattatgactgtgaatttcatctgtgttatgtatagttctttttaaaatagtatttgctatttaataatgagagtagataatcaatttgtatactactctctaattcactctttgatcctgaagacacctctcggatggtgtgtttgttgttagacctcttttacagatgacagaagggctgcatagagactttaagtgttgcccccaaggtcacacctcagataaatgatgacgtcagtactagttctggttttctgatgcacagcatcattctccattcatcgtgaagcctgtgccttaaactgtgttatgaatggtgaaagaagtaaaggatgaaaggagggaggggcccccaaactgatcatattttggtattttactgtgtagtattttggttacagactgaccagttaatttaaaggagttaacactgaacccagccaactcaccagtacctgtaaagtatgaaacggatggtgagggagaagagaaaagaggtagccaacttggctcagcagccagccagatccaggcaacgcagcttatcagaaagcagaccatcctagcatagctcgcagttgcatgcacatcatctgtttgcccggtgaggctgctgtttgcaggccgctgaatgtgtcgtgaatttttgccagagtggcattattctggctttttggtctctgaatgtgggtgagccatcccaggctctgtttggtacagtgcttttgggaagggaatggtgtgagttctcttccttttctcaagtggtccttgtgacacagctgaagcgtcctttgcagcattgataccttattgatggcctcggttttattgtacatgctgagtttccattgtaaagagatcagatctgagataaagagaagctgggtttcctttgctttctgaagaggtttgctgataccctgtctgttctatattgtctttaagcaagcaaaatcattgctgatttatatatgtgggcagttatgtatgcatttccatgagccctcatggcctgtaattctggtccagggtgtggcctctactactgagattataggacccaggttcttaacaaatggcaaaaaaacacgggcctgatggtcagaaagttgcaattaaagacgggggtctaggaacccccagtcccaggaaatccagagtcccatgacctggatcagaacctcggagagctccaggtacttggctgttggcagatatacagaggcaggagttgctctagttccaagccaaccctcctctgcaggaaggagctcttctatgtggatggataataagggacttcaaagatttgggcctcaatagtcttgggctttataggtaaggtgatctgttacatcacttaactgtggagggaagctaaggtttccactggagccacaggctgagtggttttgagtctccctcctatagtcatgccactggttcttcttaggaggtgagatgtactaggagagctctgcctagaaggctcagagtttggtttcatggccagctctgccccttgctagctttgtggccttcatctgatcttgcatcttctctgactgggtctcactattcttatgtataaaaatatatgtttggcaaaatcagttgtttttttttttcctgacagtgttgttgttaggaacaagtgaaaaaatagctgctaaagcactttaatttataagcctttgccagtgtacagttgtatcattgctagcatcatcacctatttttagagcctgtggataggaatccatgacgtcaggattctgtgaacataaggtgttgtccaagcagtgcaccatcccccaacttatatttgcatggtaattggttctgtggggtcagcatgcatgtcacatatttttagtcagaagcaagtacacagagacttgtggtttgctgttcaatttgaaaagtgtttgaatgaaagcttgtcctgtggtcttttggaagtaactggagatttctgtagggactgacaagaacaacagacgtttgagtgtccattttgcagaggctaaactgggaggggagagattgtaggcaggaagacatgattataatccaggcagtactccaggaaacagtggttaagagatgagctctcgcctgtaatcccagcattttgggaggccaaggtgggcggattacttgaggtcaggagcttgagaccagtctggccaacatggcgaaactctgcctctactaaaaaacacaaaaattagccgggtgaggtggcacgtgcctgtaatcccagctattcgggaggctgagacatgaccattgcctgaacccggaagtggaggttgcagtgaactgagatcacgccattgtactccagcctgggcaacagagtgagactgtctcaaaagaaaaaaaaaatgagagagatgagctctgaagctagacaggttgagttccaatcctggctcctacttgtctgaccttgagcaagtttgcttagccccctgggtcttgtgtgggtgtctgagtagggccatagtgtagattaaaagttgcagtccaggtgaagctcttagagcggggtttggcacatggtaagcactcagatgttagctgctattcatgtgggagtcttctattcattttattgtggtaatatatgtaacataaaatttaccattttagttattttaagtgtacagtcagtagcattaattacattagaatgttgtgcaactatccgtactatctatgtccaaaacattttcactactcctgagagaaccctttaactatcaaacagtaacttcccattctgcctctcccaacctttcaggtaacctctaatctactttctatctctatgaatttgcctattctagatatttcacataggtggactcatacaatgtttatccctttgtgtgttttatttcacttagcataatgttttccaggttcatccatgttgtagcatgtatcagaactttattccttttcgaggctgtataatattccattttgtggatataccatatcttgtttatccattcatctcttaatggacacttgggttatttccttcttttggctattatgtataaagttgcagtaaacactggcatacaagtttgccttgggggcaaagctttcaattctgctggggtccctgctttcaatgcttttgagtatatacctagaagtggaattgctggatcagatggtaattctatatttaactttctaaggagctgccatactgttttccacaggagctgccctattttacattcccattagcaatatacaaagattccagtttctccacatcctcatcaacacttgttttcttttaaaattctagccatcctagtaggtacgaaagggtatttcattgtggttttcatttgcatttccctaatgactaatgatgttgaacatcgtgtcacatgctcattagccacttgtatgttttctttggagaaacgtctattcaagtcctttgcttggcatttatatttttttccctttatgtttttaagatactacaggaggacaaaaaagaaacagattgagaaagtagatgcagccagactgggcgactgcttagatagggggataatactgaattttctactctgggtaattgggtggatgatggggtaccaaagaagacaggctgccctttcctgggagaaggggcaggttggagaaaaggtattggctttgggtggggctgcattgagcttgggtgttatccaggtggggagcctatagaattaactgccacggccatgtgtccgattggtttctctgaaaaaaatgcaagacatattttaggttttgtctcctccctgcttccacctaaagaagcaacttaagcaattcactcatcattcagcttctctatttggcaaatgtgaacaattactgggggaacaatggagtctggaatttatgggccagcctctctcctggtgccagtttctcagcccttcagcacctgctcttgatcagacccagtccttcctagccagctgctccccacgtgctgctctgaagcattggggagtaggggtgagccttcttgagaaccatggcttctgaggctttctccagggaccaccccagcctcacaatgctggcgctgcttctcccacccttccccggctgcatgccattagcagttattgctaagtagacacttgctatgtcgtcctcaacccactgactttctctgagttactccttggcaaagttgggtgttgtgctctgttgtgttactgcatcacgttgtgtctaggtggggaatttgcacgtgcacagtcatacccacactgcgatggaaaatgaggtttgagcaactgttcttcccccaaagaagcaaccggtgaggaaatgagcccacttggtggcttgttgtctttactttcagagccagagcaggctggcagccatcaccaagttagcatcctgtcatgtggctcaggcgggcaatgtttgcagattgtcccctgatgccatctgcctgtgaggctacaggaacccccagcaactgctgctctagcaggtgctggggctgctgaggtaggtgtccgtgtacatatattcaagcacacacagctttgtgtggtgtgcagaggtaccggtgttgggctagggctgagcttcgcctagttaggcctctgggacgccagttgaaacactcaacctagcaaagcgccagccccagttgttggtttccggtggggccctggtgagggaggaagagagggtgaggctgctgtgaacagaggcagcaactggggaattggatatggtaactaacacactcttgagtgtgcaggaagctgcggggagtggcattgttttgacaaacttttgttgctttctttctgcctctgccctctgctcgggcctagtcatggccctctacccaatttagcatctctgttccttccagcggggagcccatccccatttcttacctcatgggctctttttaaggagcgcattcctcatctttgagctcttcctgccattcagccatgctttgggtcagcccctaagctttcacttttccccaagttactgtgattatggattcagacaagcctagaaaatccttactcctttggggggaattcctgtatacagacttatactttgtgagtcactattatcttggtctaataatgctttttaaaacaattatgtaaattattaaagcaatttgaaataattatattagccatcagatttcagaaatctagatcttaatggagctttgattaagagtctacctagagcaggggtcagcgaactttttctgtaaagggccagatattttagactttgatctctgttgcagctactcagttccgctggtgtagcatgaaagcagctgtacaaaatacttaaatgcatgagtatagttgtgttctaatgagactttctttacaaaagtgagtggtgagctttcatttgctgacccctgatctagagtgataagccatccttattttttttctttgtcaagagttgaaaagccagaggaacttgatgactgtaaatgcattagaatcatcttcttttgggtttagtatccttgtgagcacaatggtaatttgggaatatgcttctttaaatctctgttgagaagaagataaatcagaaggctttttaagggggtgagtctgcttggccaaagcttgtcattgtttaacaagaacaggctgtcacttagagctgtatggtggcttttatgtttcactcattctctttatagtcacatggaatggccatagttacataaggtcgcctcaccatactggggcttattccactttataggaccaggtgcttttctaataaatgtaagaaaactacaaagatacagaaaatggtgtttttaaaacatgatgttatgctaagttggcattgctatagttcatttccagaaagatggagcttaagatagtccaagaggcattctaaagtttcaaactataatcttgttttccttttatctgtcctcacaggaaataaagaaagagatgaagaaagaccctctcaccaacaaagctccagaaaagcccctgcacgaagtgcccagtggaaactctttgctgtcttctgaaacgattttaagaaccaataagagaggtatggaaaaggaaaaagaggttccctccctgcacacaaacaaaagctggaaacttctggtgaactgtgtcaaactttatattgctgaaaaattgaatagagtttgtccttttggtttttggtatatattttggatacacacatacatacttggcaagtgactatatgtatagtaactgtaataaagggaactaataaaaatattttttgacagtgggaaagtagactacatttgtaaatgatgatttttctggagctgtagatttcactttcatatctatttttatggatgaaaggtgaatttagagaatgctgtggtgcaggcctgagccgtgtgtctgaccgcactctccctttaatttaaggcaaaccttatcaagttatttctctctccaactgctaggctccctagcgcagaccctgcctctctgagtttgtgaggcagaatgtgcaaagatatagctaacacatctgtctgaccagaagacctttaacaatcttgttttctctcttttgagacctcaaggcagattttcaggtatcagcttgttggagttttgttttttctcccatcccctcttggtgataattgtttgaaataatgtgagagagaatagaagactgcagagacgaccccactcaattttatactgtgagcacactagggtccctccgtttttcctgaccttggaccagccagggcacatgctgagcatgcctgtaggttagcgcttggctgccagcttttagtgggcttattacttccttaaagagaaatagagagctgtttgaaagcaggcacaggaactagattagcaaagggttccattaaccagaaaaaaagaaggcaagtttatataaccatggggaggaagaacagctaatctttcataaaatttagacaggataagaatttgtccagtaaactgcccattgatcatagctttgtgcctctcttcctttctgtctcttcctctactgcctccagctgccctgggttacatttccctttttgaattattcagatcaaatattggctggaggcccatgttggttagcagctataggattttctttcttttctcgttttgttaaattcatcctaccaaagcaggggatttcccattttaagaattaagtgccctttgctgtaaaactacagtcttgcccaaaagtgcctcctgcattcttgcaagtaagctctcaaactcctgagacctgcattcattggatttggtgaggtagagttcagtgtgtgttctttctgcactttcaaaccaatgagaaggagccctcccattcctccacctgcctcttgggtccgcgggcacggcaattgcacgcatgttgaccagcggcaaggcctctttggccagccatggtttttgtcaagtcagtaagagatttaaagtaattaattaatttaacaagataaggaattaattaaggtaaggaattgaggtaactatttggatgagtttagtaaaattacctgagaactttaaatcaacgaaggaatagaatttttcagatgattatctcttcaccactgaaaatctggcctctgagttcccctatggaatttttcattcaccaaaaattggaatgcagagggatggcttactgccttacattccattttgaaagctttctgccttggacctgcagcctggttatggccaacctttcattctgaggcattttatatgtggaatctgccggtggttgtgggacctgagtacatggaggcattctgtaaatatgaagtctataacaaatcatcttcattctgtccgaggcttcaccctgacctcctgggtcacctgggcgtaacataaatttccagctgaagggaagcattgtgtaccaggcccagggctgcctctggccctcccccaccagtcaagactaccagtattctgctaccccttataataaacagcgggggtagattgattggccttgtcaggccagataaatagttcattgtactgagctcaaaagctacatttttttcccacccaaaatcaatgaaaaaaacacttttttccccccttaaaacaaggatcagaggctaaatctgtgggatgattctagttacttgtaaacacttcggtccaactaatttttaaagttttatgagttaccataagtgactgaaggggcctccttcccctttgtttccatcatcgagctttgtctccagcaacctttcggatgttttggtctattactgttgttgtggctattagggaaggaagttgctttcaggatttattaacagcctgctttgattggctaacatgggatcttagaggatatgagttgagtccaccttgtgattcagtcttggacccttgtaagaatttaatagaatgaacacaagttctcttccttgaacttgatcaaagatgagatgactgttttctgtatatggaccttatcatttgatacatgcttgaagttggattaataatgaaagattgacatctatttctatcatgagtctgaaactgaaccacttcattgggtcctgaacttgagatagtcctagctgaagaagtttgcccaattgtgtccagctgtttttgcgtcttgtgacatgcctcactttgcagcaactgcaaacaggtagtagtccctcacgttgtgggatgagctcaccctccccagacacctgcataaggtcagaagacatcttgggtttgaaggaagctattcatagccttgagaaaaagccagggctatggaaaccttagtttggggactgattagtttcacttttcagctttaacgtttgtaaacgtctgcagagttgatttagggggtactggaatgactccatgggctttttttttctttctttctttctttcttttttattttttggaaacagggtctcactctgacacccaggctctcactctgacatccaggctggagtgcagtggcgcgatcatggctcactgcagcctcgacctccccaggctcaggtgatcctcccacctcagcctcctgagtagctgggactacaaggtacgagctaccacacctggctaatttactgatttttcgtagagctggggttttgccatgttgcctagctagtcttgaacgcctgggctcaagcaagcctcctaccccagcctcccagagcactgggattacaggtataagccactgtgactggctggcttttcatttgagaagatgatgtgactggaattgagagagagaaagtacatcctcccagctgacttggcagccactggctacacattctggcattagaaccttaggggcacttgtgtctgcactcacttctggccatttctgtggtccttacctgagtcacagtgaaagagcttcctgtttaaaacaagcctttcctgaggaataagaagtcgtttttcatttaaacttgcagcatggatgttgtatgttctgaagttatcccagactccagtatatcgatgagttaagccagaaaatgtgaaaactttacttggagccaaatgtcattctcttgatgaaccagacagaaaagagttgtatgttttcttcaaagaatgattgattcttttgtttcttctatcattaaacccataaaagagaatgatgggccctcctaaattggagcattgatatatagagacttttttaaaaaagcattcaaatgccgagattgtgccactccagcctgggcaacaagagtgaaactccatctcaaaaaacaaacaaacaaacaaacaaaaaaaacgcattcaaatgttgagtttagaagaaaaattgaataaaacggaagtttgaacagttagcatatatcctaaataggttcttgaaaatgaacagtggatttttgtccatttgaatatagactcttacctacttgaattaaaaatgaaataaaaaaatcaagctggacacagtgactcattcctgtaatcccagcactctggaaggctgaggtgagaggattgcttgagtccaggagctcaagaccagcctgggcaacatagcaagaccccatctctaaaaaaaataaaacaattagctgggtgtggtggcatgcacctgtagtcttagctactcaagaggctgaggtgggagaatcacttaagcccagaaggtcggggctgcagtgagctgtgatagcgccactgcactccagcctgggtgccagagtgagaccctatctcaaaacaaaaaacaaaaaaaagaaaaaattatttgatccttagaaggatttcctggctaactttattcatgtgatcagttaagtatccaggctgtcatcaataccctgctggcccgtgtgaggaccaggttccatctcagggttctcgtttgcactgttaacagtgcatgcagagaagatgtatctctgcctctctctgaacctctcctgttgcctggaattttggacattgttccttcctcactttttggtagacacccatgaacattcaatagtacatgtttagtgcatgcccactatgcatctgcccttgtgcttggtgatggggcagataaagactggaaaaacaccagccagtcctgcctgcaagtaactcagtctgttgtatcccttgggaaacgttgagaaagtgctgcacgtttcttatatcattttgatggcaaggtggggatgtgtcttgtatttacttctgtcattctgaatgtgaagccactccgtgggtttctggttggctttatatgtccttgtttctatttccagtttatcatgaattcagtgtttggtaagtctctattgtattttgcacatttactattttttgctatattattatgctctcctgatacaaaatgtattttatagttacctttttaagtcgctctgctactttggcatctgccttcccaaagataaactgcttttaccatctttatttaaggttttttatgcatttgcattttactgccccttccagagattaatgctgaaagatctgacggtttaaaagatgttatttgtaacaggtctagctctgatgctacgaggtgagatcgtctgtctcatgagattcaagttaagatgggggagggttgctctctgaattgatatgtgggtatgactgattgtagaacattgctctgtgggttcatttctggtgtgtttaatccttcagacgggttccattcaaaagttttccttaacagagggatcaacggctgctcttcctctggtgacacactgttgctttaaaagttagtgcagaagttcttccacattaatatggacctcgtgtttgccacatggaagggctctccagtttggtctgctacctgtagctgtcagaagaatgttgcttaatgtttacctttcttctcatagtttcagcactggtcattccaagccctaaacagatctaagtgactgcccgtcctttccccacttcccctgaaggggaaacgttttttctagcttttagtgtgagggcctggaatgcttctcatggcgccaaggcggtggcgtggatcttgataggccgtgagctctttggcagaaatgaaactgttaacaaaggatggaaagaagtatgtccttagtaaagaaaatgtcaacctctttggtttgccagtggtttgttgtttaaggtaaatgtgagatctgggggtttgtttgtagagatgagactttgtttctttcaaattttctattggagaaataaatgtgaattcttgccagttaactgggaatctgaaaatgtgccatttggggtcagacttttctttgagtttcaagattgcctgtttatttgacttaaggagctggtgtttatggacagatagaataagagttaacagaagacattactgttgtgtagaagctcttggctatcacctgagctggtctttcccaggggaaatgaaaatctggcgatctggcagtgaatggggatagatatgatacatagtcattcagtaatatatacgtctgtgtgaatgtatctgtatacgcatctatagtcttattttccagtgggccttcattctcaaaagctctggagtcaagagcctttaaagaagtcttttaaactaactgatccctgactgcatttctggcaagttttattgggacactgcgttgttagcaccagcaattgatgttggagtgtgtgttaccctttttcatgttattttctgaacctattgagcctagagtgaggggtggtgaaatgcatggtaagaactacataggagggtatagccatcatgttgcgattatgtgtgggtcattgataaaatcggtttttagatttttttttctgttatgtttaatctcctttctatctctgtgtcttctgatttcaaggcattaacactaatgagtctcccatgggttagtcatgggtttaagactcccgccatactcctgctggtgtccgcccaaatccacccagaggacaagccatgaagtgggtttgtggtggtggctccacctggtggctctcctaggaaactcctctttctgcccaccttttccttctccttgggagaatcttgatggaggatgcctttgattcctctgactcagtgttcactatttgtgcagttccatcccagacccacggcttctcacattacttatggatttttttagcccttttgctttttcgcctaagaattgctctttgaactcatataatctgtgtcctgatccttgttctatctgtgatacccctatggaccaggattattgttaatgaggattaaaaaaaaaaaaggactcccataggcatgactctagatatagatattaatttggacaaaataaagaatcacactgaaatccctgtaggtatgtatgccaaaatctcctgcctaatagctccaagtacccttatctacttcttcttcactttttgttgaacccatttttcctcaaaggagcaatattttattaccaatgttgttttcaattgtcagcaggtggcgaaagtaaaaagccaactaactttttggcttcattgttgtttcattattgtttgtgaattctctacaggcagcccccttcttgcctgggcacagactgcccccgcttggtatgtcactgagcataagtatttttgataaataaaaatgtcttttattctcattatttttcagtttttagttgttgataatattgcagatatgacttattttagctgcattgtgggtcagtctgggaacttaatcaccatttataactttgcttctatgggaataatgcattcagagttccaaactctctgcataaggcacatataagtctttttttttttttttttttttttttcttggaggcagagtctcgctctatcccctaggctggagtacagtggcatgatctcggctcactgcaactttcgcctcccgggttcaagccattctcctgcctcagcctcctgagtagctgggactacaggcacctgccaccatgcccggccaatttttgtatttttagtagagacgggatttcgccatgttggtcaggctggtcttgaactcctgacctcaagtcatcccccagcctcggcctcccaaagtgctgggattacaggcgtgagccactgtgcctggccaagtctgacttcttttttttttttttttttttttgcattgctgacatgaatccttaagtacctttgtaaaagtcagagtccgtataatcggtgcccactgaagtttgctcatgttgcagaggagtttataattcacacagtatagaatgctggaactgtgcaagctccacacagtacactaggctctgaggatagctttgggttcaatcacattgcaccattgtatatggtgcttattttcacaaggcctgagttggatcttagtgtgcccacgtttgtatgaggcatgtcgtgaaagtgggtcctattgtatatttccatctactagtgacgagaccttgcaccaagcgtgacatgctcagatagaaaccagcccagcatttctcagtgtgtgttgtatggaattatagcccttctgactattccacaaaggagggatgcggggagagacaggcagacaagcggggagagaaaattgcctctctcgtcaaatttcagctgcagcactaacaccatcttggagactgacaagcacattagcatagtacaggctctcagatggcctatggtaaggagacctgcttatctttgatcatggaactgcatgttattggatactagttaagactccactttgggatatgttgggctttaagatacaggacaaggagctctgtaagcatccccaagataatcttcaggttccacctctcatgggaaatgtttgagtaagtgagtggagatggtggtgctggcactcagagaaatgactggcgaggcttcttaagcctgcgctgtcaaaaaacatgagttagatgatgctaggagaacattctttgaatctgaaacttgaaagccagtcctcttggtagtttttcaagtgacaagctgaaagggaattttccctctgatcatttcttgggtccttgtatctaagaatgaggcttagacacatgagtggaagtcctagtctgggctttggcatgaaaagcaggctgaggggacccaacctagcaactggtgaggccagggtgttcaggtctacctgggacttggatcacgatggaacctgcgattccagaggtggtttttattatgatgacagtctctacatagtcaacatagtctcattgccttctctacttgctttgactgaaagacagaagtcttagcttttcccgatgccattaaaacactgaacgtttataaagaagagccttcttctctccctactagtgaaacaggctggcatttgagttcaagtaataaatccacatgtggggttgtgaggaaaaaccacatagcctgcctttttagaattctggaatcacagagttacagaggttacagagggacccacttattgacatcccaggcgaacgaacatggagcctctgcccagggaattgaaaaggacactccttggctctggccttggctaagccccacgtgggagcctcctttccaaagggaagtttttctgggtagggaactgctagattaatgaaaggtaatcaggccaggtgtgatgacttacacctgtaatcccaacactttgggagggcaaagctggaggatctcttaagcccaggagttcaagaccagccggggcaacatggtgagatgttttatagtctctataaaaaatacaaaaattagccgggcatggcagcgtgtgcatgtagtcccagccacttgggaggctgaggtgggaggattgtctgagcctcggaagtgaaggttgcagtgagctgaaatcgcaccactgcactccagcctgggtgacagagcgagaacccgtctcaaaaaaaaaaaaaaaaaagtaattagaggtagatgatatttaggtgctggttgcatttgttgcattatatggggacagcagctatattcacttgcagtaagctctggaaaaggggcattttcttctaattatatctgttgatctgtcatcacagcctggtctctctgatgccatgtgcagcctcagcttagtctttggattcttggctttttgtgcttctgaagccttaagactgttgtacccaaacaatgaggacatttcatggcccacctccctaactcatgattaggccaacagcgggcccagctgcagtgccaggtgggctgccctcattgtttcaaccaggaagggaaagagagaccagccagaagcttcctctgcatgtgcctgtgcatgaaaaagagcatttgaggaggactagcctgcttgtcgcatttgtgtttctctggagacctgaataggttcagtggcagcaggaccttattgcagggaggatggctgttgggaggacccagaccactcctgctgcacctccacagcttctgcagcactttagacaagttgcagattccccctgtgtttccaggtttcccatttgtaaaacaaggaaatgctcttgttaattccttcagggcaattgtgaagattaaaaatgagtaaagaaaataggttttgggatagggaggcaatagagtgaagtggggtagggtgtcactcactgaatacagtagtaattgctattaaaagtagtaaactgctagtaagaccccagagcattgggaaggaattagagatttatggaaaataataaaacgtgttttcatgaaacaacctgtgatcacatgcacatggcaccttctccaggatggaccatatgctaggctgtaaaagaagtctcagtggccaggtgcggtggctcacgcctataattccagcactttgggaggccgaggcgggtggatcacaaggtcaggagattgagaccatcctggctaacacagtgaaaccccgtctttattaaaaacacaaaaaaattagccggtcatggtggcgggctcccgtagtcccagctacttgaaagtctgaggcaggagaatggcgtgaacccgggaggcggagcttgcagtgagccgagatcgcgccgctgcactccagcctgggcaactgagcaagaatccgtcccccccaccccccccccccgccaaaaaaaaggagtctcagtaaatttagaaggattaaaatcatacgaagtatattctccaatcacaatggaattaaattagaaatcaacaatagaaggaaattggggaaattcacaattacatagaaattaagcagtatgctcctaaataaccaatgagccaaagaagaattcacaagggaaattttaaaatactttgaaattaatgaaaatgaaaacatgacatacaaaaatgtactgcctgtggctaaagcagtgtttcaagtgaaactgacagctgcaaatgcctatgtacaaaaagaagacagatctcaaattaatagcctttctactttctactttaagaaactagaaaagaaaagcaagctaaactcaaagcaagcagaaagaaggaaatgataaaggttacagtggaaataaatgaaatagagaatcgaaaaactatagaaaatcaatgaaacaaatagttgatccttagaaatgatcaacaaacttgataaaccttatctacactgatcaagaaaaaaggagagaagatttcagttactatatgaggagttaaagcgcgaacatcactaccaatcttaagagaaattaaaaggattgtaagggaatagtatgaacaactcacccactgctggtggaaatgtaaaatggtacagccactttggagaacagtcacccatatgacccagtattccagactctagaaaaatgaaaacatatatgtccacacataactgtacatgaatgttcatagcagcattattcataatagccaaacagtggcaacaacccaaatgtccaccagtggatgaatggctgaacaaaatgtggtctatacacaaaatggagtatcgtaagaaggaatgaagtcctcatatatggatgaaccttgaaaacattatgctaagtgaaagaagccagtcacaaaagaccgcatattgtatgattccattgatatgaacgtgcggaataagcaaatccctagagatagaaagtagattagtgtttgcctaaagctgaaggtgggaatggaaagtgatttttggtgggcgtgaagtttctttttggggtgatagaaatgttctaaaattacactgctgtcatggctgtacaatcctgcagatacataaatccatttaattgtacacttgaaatgggtaaattttatggtatgtaaattatatctcaataaagctattaaaaaatacaacacaaattggggttaaaatgctatgtctgtctgtctgcctctttctcttttatgtcccctaccactaacctccttcccacagctgagggacaagatgtgtcattccatttattcaagtctttaaaattatatatttctcagcaaagctttatatttttctttattcaatcagttgcctaggagatagtaggtctgagggatcaaaaagacactgttttgctaagggtgacccaaatattagataatcgatttgagaagggtagagaactggctgtggcatcctattgttcatttcttgagaaaaaaatgagattctctgtaaatcaaaagccaaacctcttatattctaaattctgtgcttcgtagaaagagcctctgctagaaaggaaagaatccatttatgtttccagtttttcttgccgttgtcagtaactgcgttggctatttttgctcataaatctttatccacagctctgatgatttctttaggaaagatttctcagatgtggaattactggacaaaagtgtgtgtatattttatggtacttggattcattatcaaattgacttcctgaaagcttgcactgatctgtctcactactgaagtggggagagtgctgcttagtgttctaagcttgaatttctcagattaatcgagtgcttgaacattttttcttccgtcatttgttaataatctttgcactttatattgaggtccttatttttttttttactggttggtgtactattcctttgtcattcatggcaaattttgcttcccaatttgtttgcttttcattttgtttacgattgattttgatgcacagaaatagtaaatttttatgtagattggtatattgatgctttcttttgtgatttctctgaataaattatcacctagcttatctcctttttttatactggcttcattttttacttcaaaattttaatctgtatagaattttgatgtgtagtatgaggttagtatacaaattgatttttattttgaaatagccacttttccaggaccatttattgaatagccctttccagtgattgtatgatacctcatttatcatataatattattatatatatgaaagtctttgggctttcaattctataccattaatttgttttaccattcttaatatggttaactattatggctttataatatattttaatatattgtatggcaagctttcagccttcctatcacccttcattttcaaaaaggatttagttactctcatttattttaaaatcatgtcatcaagttaaaattttaatttcattcaaattataagtcacttttagaagaattaacatttttctaacatttttgtttaaagctttgcattgttgcataaaccaactttatatacaagtatataagtgaaaaccttttctcccccacctctcctccccaaacatcacagtaggctaattcttgtaaattaaaacatctatccccttctgaattctaaacagcttattctagtcagccagtgacatgggatgtcactctgttgagtcaagtgttacagttttatttgtgcagtcttgcttgttgatgacgttattcccagatagatagtggttattgttggcttttgtaaataggatctttcccctcatattttttgtattgctggtacgtagaggaatttaacttttgaagatttctttacaatagcccttgtggaacactcttgctaattaaaaaaagttcctcttttatatttagaaaattattagtacctatcagtcactagttttcagaaggtggataagtggaaattataaaatgctgtatttgaacaaatgatattttagaaacaaaaattccttggcttggatagaacgctgtgtgtgtgtgtgtgtgtgtgtgtgtgtgtgtgtgtgtgtagggatttttatccaaattaaggaattttatatatacagttgacccttgaacaacacagctttgaactgcacaggtccacttatatgtagatttttttcagccaaatgcagatagataatacagcatttgtgggatgccaaacctgtgtatacagagggccgatttttcccgtgcttgagttccacagagccaattgcgagacttaaggatgtgtggattttgggatgcgctaagggtcctggaaccaatctgccgggaatactgagggatgattatatatgtatatatatgcagctgttaacagtgttatattgtatatttcaaaataaacagaagattttgaagttttcactacaaagaaatgataaatatttgaggcgatggataagctaaatacccttacatgatcattatacaatgtatacatggatcataacatcacactctaccccataaatatgtacaattattatgcgtcaattgaaaagaaaacttaaaaaagtggacatgtgcaaacctcaaaaaaaatcaaaagctaactttcattagttcatattatgaaaacaactgtttttgtttggtttttcaactatgacagtatattaaatgaaaaaaggaaaaccttagtcatctgatcttaatgatttgtaatctgatcttagtgatctgatcttaaatgaatttttttatatatttggggctgcatttcattctattaatgcatttttattcttccgcaagtgttgtgcatgtttaggtttttattttctttactagattataaggcgcttgaaggaaagaaaccacatcttattcatcttggagctcactttaattgttgaatgaagtatatgcttgtactcatataccctaatccttttgaaaaacaagttacttcaaggcaaactaccagagggagaactaacttattaagttacatggttaaggggaagctgttgaaattctgtgattcagagaaattgtctttggtttctgagtaccgagggagagaggagacttattaaacatctgttttaagagtggatcctagaataagtactaaacctaggtcttggcctgaccacaggcagtttactagagagagagaaggtgaaatagtttcagaggaggaaattgcaactagatcttgagtaatgagattgaaggtggagctaagttagaagggtaacactgtgctcaaagagaagggtcctaaaattttcacattcacttgtgtaacatgcgatggcgagtgcgagaatgtatacaagacaagggaaggtttcaatttcatgtgaacattttaatctatatttgattttacccttttgcccaaggttttataaatgaaagtgtaggccgggcgcagtggctcacgcctgtaatcccagcactttgggaggccgaggcgggcggattacctgaggtcaggagttcgagatcagcctgggcaacatggtgaaaccccgtctctactagaaatacaaaattagccgggcgtggtgacacatgcctgtaatcccagctactcgggaggctgaggcaggagaatcgcttgaacctgggaggcggagggtgcagtgagctgagattgcgccattgcactccagcctgggcaaccagagtaaatctccgtctcaccaaaaaaataaacaaataaataaaataaaataaaataaatgaaagtgtatagagttcagtttattttctatatagatgtgtactcttccctttttgttggagtacatgggccagacctagcttttccttcatttctgggcttttccttctctgatatttgattcctcatcactttcatcaggaccagggagggaaagttaattttggactatgtgattatgcatcagttttgcctgtcaggaacctagtattatgaatgattaatgattagtattgttctaagatttcaatttaggtaaaatttatctctctaaccacctgcagcttgcttgttgaagattctgtaacactagagcagggaggtgacaatccctgtgggggtggcctgagaagctcttttctcccctcccacccttagtctcttcttgcttctttttcctctctgcccccttcttttctccctagggcccacttggatggattctttggtattgtcattccttacaaaggaaaataaaaattcccagatagtttgccactgagttttccctttaattattttacccctttgctagcccacattatttgagagattaaagcaaacaaatgaacacagcgtgctgcttaatagttatttcttttatggaaatagagttctgctatgttgcccaggctggtcttaaactcctagcctctagtgattctcccaacttggctgctcaaagtgcttaatagttattttttttaaatattgtttagggaaaaaatgataccagttgttttatatttgaccttttttaaaaaaaagctttaaagcagctctttgataatatcactagaagtagtttatttctttttgaagaaattagcttcctttgtaatttacttttgactacatcattgagataaaaggtaaggcagttgaaactatgtacaaaaaggaaaaaaaaaatcgctcagttactgatgggtctggcactgtgtggttagggatgggaaaaccagcatacactagaaatgaaaatcctgtttctatttcatacgtatacatatactttaaaaactttacatgttccctcctaagctttggccctgtagctcttgcccttcttgcacagaactcatgtgcaattcacattaatgttgaagagactcctttcctccctccttctctcccttcttccttctttcctctgttcctttcttcctctgactctctctccatccttctcttccatactttctaaggaccatcccattctggagtgggcccttagggtgtgggtatatttaagtgtgtgtcattagctcttagttaccttttcacagagttgatgggaataaaatggaccattgaaatccaggaatgacccacagaaatgcttttgcagtttaactctaaacctttttattagaaaggcttatataggatgtgatttcacttttctcacttcctgctgatcctctcaggtggaggtgatcataaatttaaaaatgaccaaacctaggcagcaagaaggaagagaggtaagcatcagctggggattttgtaggatcagtctctctccttccacatgttcataaattatgaactgtatcgatccattcacattgatgtatgaactcattctgccaaaagcccaagttgaagtggaaaatggaaagtgatcatttattagagctgatgagtgtcagctttgtactgaaacaaagaaaacgaaaccacacaggcctggacggcctccccttcaaccctaagattctgtggccagaggcaagtgggcctgggggtaaccagcaagacttagtaacagtttacaaatatcctgcctgttttcagtggcttggaatcagactgttatctccttgaggctggaaaagcatttctgtgcctttatctccccatgacttctgcccaggatgattcagacaccctcactggaattatcttcatctgaataattctcagctctatcagccattatcaatgttgggaaggttatttcacctttttaagcatcgatttcttcatctgcaagttgaaaggttgagaagtttctagtatgtcttcagctgggcatggtttctaaaagcttttgttcctatcttcatcagaacataactagttctccagttcagggtcatggtactgtttatatagagtcctcaaagcattttaacctgtgagccctcatttggttattaagcttttggaaatgttgaaaagcttaagcatcccacttctctctttgcaaaccctccccaacgttcccaggaagaaatattggggtccagtctgtgtaccatcagcccattctagctcctacagctgacaaacatttgttgaacaaatcaagttcccacatgaccagtcagaagcctctggagagcttcaaagaattctttgctgagaatgccccatggtgattttgttgagtaatgaagttaaaataatgtttctgtctttggtaaaccacccattctcacctactgcatggcagcatgggtttctgccagtctttactcagcttgattgcacaaggttgggcaggtggtgagatgtgtattcactttgccttcagctcagcatgcttcagaatacaggtttagcatcccaaatgtgaaaatccaaaatctgaaatgctccaaaatctgaaactttttatgtgctgacgtgacgtttaaagaaaatgctcattggagcattttggatatcagattacagatactcaactggcaagtataatgcaaatattccaaaacatgaaaaaaaaatctgaaatccaagacacttctggtcccaagcttttctgatgagggatattcaacctgaactgcctcttccaaaggcttttgcatatcatctccatatttatttcagtgggtgtgggatagaatcacaaattctagctgccagttccttctcctcaacctgttagatgatagctaaagattgctagctaagtgatacttttttatttgagatggtgtctcgctctgtttccaggctggagtgcagtggtgtgatctcggctcactgcaaccgggttcaagtgattctcctgcttcagcctcctgagtagctgggacttacagtcacgttccaccgcgcccagcacgtttttgtatttttagtagatactgggtttcaccatgttggccaagatagtctcaatctcttgaccttgtgatctgcctgcctcggcctcccaaaatgctgggattacaggcatgagccaccacgcccggcctaagtgatattttttaaagcatgtttaatatttcaaaatgaggttttaacagagacacatagaaagggatcaacaagggacttgaacaaatatttgcacacccacattcagagcagcattattcgcaataggcaaaaggtggaagcaacccaagtgttcattgaggatgaattgataaacaaatattatccagccttaaaaaggaaagaaattatgacacatgctgtaacatggatgaactttgaggacattatgctaagtgaaataaaccagacacaaacagacaaatactatatgattccacttatgtgaggtacctagagtagtcaaatgtatagagacagaaagtaggatggtggtttgcaggggctgagggagggataatgggcagttattgtttcataggtatataatttcagttttgcaaaatgaaaagacttctggagatggatgttggcgatagttgcacaacaatgtgagtgtacttaatgccactgaactgtacacttaaaatggttaagatggtaaattttatgttatgaatgctttaccacaataaaaaaggatcaagaataacatgacaaatacccaacacccttctacccactaccagctaagaaattctatcaattagcaattacagttgatctgtcatgtatgttaccttgtctcagttgcattgtgtgtgtttcttgagaagcgtgatggatgacttgggtaagagaattctgggtcaagagagcattccttctcctgttttcttttcatttttatttgttagttaaagataaacatagtacaataagtaaaaaattaataacctttctctgtcctttaaaattagtgttcctaactctaaaaagcaatgtttctagaaacttctgtttaccctttgggctctgatgaatgtggagaaaagagagagaacacttaactcaccaggatggaagaataagataaaatatttgcaacctccttcctccctgaatgttgtgttaaacgtttttttgaggacttgcgctgtgtcaagtgttgtcgtatcagttatctattgctacaatattgctgcataacaaattactacaaaaccccagcagcatacaacattaagctgctctgtgtatcttgcttgcattatgtgtacaacaaacccctatgacatgagtttacctatataacctgcacaatgtacccctgaacctaaaataaaagttaaaaaaaaaaagaattaggaccttaatgcaatcagtacgccctagttacctatgcaaatgttgtagtggagacatctatgcagtcctttaaacaaccctgagaagtaggtggcattggcctcattttgcagttggaaaaagcaaggctcagagaggttataagacctatccaaggccacactgttagtgagtggtgtagtttgggtttgaacctgggtctgtcagacgccttcctccatgccgcctctgccaaactccatgcagcaccttggattaccacctatggaaacattctgttttgccttttgtgcttctatttgcccctcccactcccgctctactcctttctctattatatttgattgagtcctcttctccaacttctgaagtgtaagctgtttctatagtcctgtctttggcatcttcctgggttcagctaatgccatgaagcatacgattccctaagcccaacctctaggctggccctccctccttgctgccttcatgtccactctcagacactctgtgctggctactggtttctgggctgcaagtcataggcaacgtggttccatctggcgtaggtcatgaggaaatacctgtcttgtgtaacaggaagttgtacacacacagggcaggcttgtcagggcccaggtttcttttctgtgccctgcctctcctggagttggctttgtgctgtgaccagcaagtggagcaacagtggacttcccagtttacatccagtggggaagtgcaggggacctctcttcatttagatgctctgggcagacccacctttgtctctcactgtaccaccctgacctaggactgcctgcccatccctgaacctatttctggtgggagctgacccacgtctggtggtctgtggtggagtggcagatgggagacagtcactgtgtccccaactgtccctatgtggttgagcagcagattctctctcctgtcagactcctgttgcttctgtattctgcattttatttgtttttatttatttttttgagacagggtctcactctgtcactgaggttggagtgcagtagcggaatcatggctcactgcagcctccacctccagggctcaagcaatccttctacctcagcctacccgagtagctgggactacaggtgtgtgccaccatacctggctaatttatctattttttttttttttttttttagagtagagacagggtcttgctatgttgcccaggctgggttcaaactcctggtctcaagcaatctgcctgcctcaacctcccaaagtgctgggattacaggtgtaagccaccgtgctcagctgtgttctgcattttagttggtggcattaccaaccttcacttcctcccatcgacactttggggtcatttttaattcttctttcttcttcatccccttatttacttacatgttttgttctaactttgtttatgagatggttgttaaaggtctgttctgggctagcctgtagtaatccccaaggaggccagctgagttcctgttcacagagtctaggatttgagaatcaaacaatccccaggcagcgtgggcagggtaaagagaacattatacactgggtgctgtgctctctcatggttgttattggtggtggtggttgcaggggaccataaccctgcctcaaaagcagtcagggaaggtgtctgggagggggtcacatgtaagctgatgattcaaccttagccatgtctcttgttcttcctttttaaaaaaatattccctggtttctgatttggactcttaacacttcttcctataaaccagaagtcagcaaacgatggcccatgggccaaacctggcactggctgtttttgtaagtcaagttttattggcacacaggcacacccattcatttatgtgtggtctatggttgttttcaccactacaatggcagagttgagtagttgctacagaggccatatggctcacaaagcctgaaacattgactctctggccctttacagtaatagtttgctgatctctgcggcagaccattagaaaaaccgaattcctgcctgccgggaagtttcgtcttgcaaaaagagatatacgtaatatatagaaaattttataataaagccctttgaggtaaagacaattaagtgctgaatacaatatttaaatgctgacaaaaattattgttggggagattaatgtggatttatttttccctactttctctatttttctctgctctttctctattctgcaaatgaatcttcattcattttttttcgcctcaggatttttagactgacactttctagatttataacttctaagtttacacttttcatgacactcactttctgccctctgagagggggaggaaaggtatggatcagtttggaaaatgaagtctgggtgagatataaccccctcttttaaaaaaatacacctttgcacctttcctgtatttacaaggaaagtgggatttgtttaaataaagagaaaagtctttatctgcttcgaataaatagataggacgtgcattactaacctgtttgtttggtggggtcggcgggggacatctgcttaataatctgcccttttctggatgatgcttattccccaccccaccaagaggggactgatttgttgtttttctgatccccacacaatcatctgctcagtagggcagcttttgtgctattgggttgtttacacctctctgctcttttaaaacattttctagtttgaccttttcttttagactcatcctaacttttcttagacttactataaaaataatacatgtttagtgtaaaaaattaacagagtcaagtcatggtgtaaagagtcacatcaaatcccttccctgagtcatacttcctggaagagacttggttcatggtcatccctacagatctctgtgtagatattaggaggaaccataagcagatgcagatagtcatttgatcataaagatgtcaatttcaaacacatagtggtacatacatcttggcattttttaaaaacacagatgggatcatactgttcaggctatattgcaatttttgtattaagttgacgagaatcttggaaatcttgccgtatcagttcatttagagctatgcttctctttgctagtttgtgtggagatacacctatggcttaattaaccagttccctgattgaaggacgtttaggataattctggtttttcactattctgactaatgtagcagtggacattatgcatatatctttgtacatttcatgtgagttatctggagtataacttcctgaaagtggaattggtgttttcttgactcttttacttttaacacttttttttttttttttttttttgagacggagtctcattctgtcactcaggctgaagtgcagtggcgtgatcttggctcactgcagcctcaacttcccaagctcaggtaatccacctcagcctcccaggtaactgggattacaggcgtgtgtcactacgcctggctaattttgttttgttttgttttgttttttgtggagatggggttttgccatgttgcccaggctagtctcgaactcctgagctcaagagatctgcctgccttggcctcccaaagtgctgggattacaggcatgagccagcatgcctggttgagacattttttttagacttcttttttttttttgaagaactggtcagatgcctctggtcccagctggccatgctgaccatagggtccttcatcctctagtgataccacagaaatggacctcagtggaagtcaggcaatccctccaggcagatcctgtgcaattataaacattagcatcaacttccctccttctatggaatatttctgtgcttgcagcccggcaggcactggggacggacacacacacacacacacacacacacacacacacacacacacacaccagtgcgcacgcgcacacacacacacacacacacacaccagtgcagctgagtagggctgggagcaaggggtgtgtatgaagccgtgtgggtacatggaagccctagtgacctctttatacccgaaggatagggggaaacttgtagtgctttccagaatttaagtagtcagaaaagggagagaaaagtagggctgagttgggggagggtaatgaggctgtggcaggtgtcagcctgcaaattagctgtgctggcctccctggaagaaatcatgggcattgagctcagccaagccagggcaccagatgacagagtggggctctcgccagccactgacccaagtaataagagggcacttggcaagcagcttcatgagcaccgtgccacgtggccatttgtggttcaggacttgcgaagttgcccaaagtggctcttttgttatgatgtgttactccaaagcttatgaagcattccaatgaacagagtccaaatgttatgtttactgctttgttaaatataaatagtttacccttgtacctttgggtttccttggaaactgtaatttttttaaagataggttcttgctctgttgcccaggctggagtgcagtggtgcagtcatggctcactgcaacctagaactcatgggctcaagtggtcctcccatctcagcttcccgggtagctgagactacaggcacacatcaccatgctctgttaaatttttttatttttattttttgtagagacaggttctcgccacgttgctcaggccttgaaattctgccctcaagggatccttccaccttgacctcccatagtgctggaattataggtgtgagccgctgcacccagcctggaaattacaatcttgaaagcagggattgggggttctttttatttaaaaaatttccatggaacctgtttgccagtctggtgaagcctgtggaccccttttcagaataatgttggtaaatgaataaaaagggaaccaaagaattacaaaggaaaccaattatgttaaaatagttgtcaaaatagtacaaaaatacaagcaagacatatgctttattatagcaacatccagcagtgggtcaggaggtgatcataattttgaagcaggggtgagtgtaaatgatagttcaagataactgcaactgtgaaatgaaatgaaaatatctattcatgtagtgggaaataaataaatttcatagatgctgctagtaccattgtggtttgttgcttagattcacggtgagaataaaggccaaatttcagaagatagtaaaagatgtatttttcttcccatgtaagtttagaccccctgaattctatccacacaccccagttaaggacctctgcttaaggggtttagcctttcagattatgaggaatgaattgcagggatataaactcccatttgcatcaagaaaattcagaaatacctaggcttcctcccctctttattctgatggggatgagaagggaaactatattaaaaatgagtcaaaatttaaaaatattatgactacctgcaatgaagatctccccctacccccaaaagagagggtacatgtggaattctttgacactttctaaatctccgagcacagtggccatttttggtactgattttaaaaactgggaaaccctagatttgtttatggtgtgtatctcccacccccacaacccacacacacatacctcccagtaattctctaagattaggcaagacagaagtatcccagatgaaggtctttaggattttctagacctttgttacagttcttcaaatgtttgtgtctttttttctcctctcctacccctcattccctcatcttttccccctccctgcccattctacctttaactgtaaaagttaggtgtctgatatattcatttgtcagcagcaaagtttgagaatgcctttaaaaatagatatgttagagggagtatgttggatagaaaggagaaatcttgtttatgctcaataaataacttacatttagaaccttccttcaatttttcctttgaaattctgtattctcatttcacttgaatgactctgcatggagcgtttaaaagtagatcaaacaaaaccctataaatatgttgagttcttttgggcattttgccaaaattagccttgcagggaaaagcagtgtgctttacgtattggattttctcctctgaaaatccagactccctctcctctggagagctagctgccagggctgggggaaagtcaagccagggacacattagggaagtgtccctggtatggcctgctgaggttgggttatttggattgagggttgtgctgaaaggccaaaaccaatgcctgggaccagcctgaagaaagatgaaaagcagagggacgtttagagacgtcactgattttatgttatgacgtgattcctttatctcactctgattggaagggaaggctggtgaaaaaaacattaacagagctgtcttttaacagattcctgaatgtaaagccaaatggaaaaaagggagagagtcaggtggaagtaagccccttggaaagtaggtctgtctccatcatcccaattttatacgtgagaaaaccgaggcagagagccacgcaggggttgcaatgctgggtgagttgggccgtttgtctcttctgtattgttaactcagggttctctattattattattattattgttattattattattattattattattattagttagaggtggggtctcactatgttgcccaagctggtcttgaactcctgggctcaagtgatcctcctgcctcagcctcccaaagtgctaggattacaggtgtgagccaccatgcctggccccagggttctcttttatgtgctttaatgctttaagtgaagaccacgtatccatgagcagtgaaatcagagcccctgcaccctttcacatggctaattcacatatcatttttataagatatagttgaggtggaggatgttgagttcttcatgctcatggcaccaaaattacagatgtggcttctaaagaaatatcagatgacaatgttaatgttaaaatatacatatacagctcctctttgcagaaactcagtttattcaatggatggcccctttgactattacgttggaagtagaaacttgatttgggggggtcagatgttaattgcccaaatttaagacagttttcagtgacttctttaaatgaggcattagactctgaagttcatagggctgaggagggcctggatcggggattttctagatatatggcacctggggtccacatagggatctagagtggtgcagtggcatcgccctaaccatcatgaggcagatgtgagtgagtcgaattggttgatacagatgtgcgtgaaagagctgagaggtgtcagggttgaaaagatggagacagacagcaaccgacactcacagataacaaaaacacaatggaaggaggacagtgctagagaaaagcaatggttgttaggagaacccagagaaggggcccccacggctgaatgaatgagtatgtatgtgtgtgtgtatgtatgtgttcccatgagtgaggggcgagctcggaagatggacaccacagggcccctccacctagtgagagatggctgtctgggctgtgtaggctggtggtgtctggccagggaagataaccttggcttggtcactgatggaatagtatgggcctcctcagggttctgtaacagcatctgatcagaataatgactaatgtgggctacagatgtggagccctgtctctgagctcacacctcctgctgtgttcgtagaccagccacaaccagttgtcattgggaggtccgaggccccttgtcattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtgatgtttttaaaaagtgattacagtatattacgtgctctttgtgaagacaaattgatattgtagaagcatttaaatgagtttctacccttcccccaatctgcctcccctgaagtatcactgttactttggggtatagccttccataccattttctgtgcttacacaagtgtgtccgtgtacatataccccctttctctcattcatttgtatctttttttgagacagtctcttactctgttgccctcattcatttaattgtattagaccttcataaattagttgaatgttgaatggattcatttatttattaatgaacatttgttgaatgtatactctgtgctaggttccgagttatcaggagtaactaaaatgctacatgctgcttagagttatgagtgtgtgtgtgtgtgtgtgtgtgtgtgtgtgtgtgtgtgtatttataaaattgggatcatagtatacatattacgtgatttagtcttttagtgtactatggacaccttttcacactgatacacgtagagctacttgttatatttaatggctgctggatataccttcccctcccagtagacatccaggtttcacatgtagatctctgtgcatatatgcatttgctattagaaacaatgctgccctgaaccttcttatacatatatctttgcctacttaaaccaaatgttttctgtcttttaaggggaccgaatataaaatcaaacatacgtcatttcttgttcatatatagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactagttctacattttctcttatatcctgccaagacttgggagaaaatgagcactggcatagctatacccacttgtcagatgccctctgcctttgaagtagcaggcaaatggatttcctgtgttctgcggtgcagagatgttgattatacacatccctgtgaaaatcaagcaggctcatctccagggaccacacaatgctggttaattaaatattatacatttccactgcaacagtccaggtacagccaagaggggtttgtaaagaaacacccacagggtccttttatttggagtgccattggcttctgaagtgtcctcctcttcctgtgagttgcattatgttgaaacaggatgacgagtggaaatgtttccagtaaagagtatgatgcaggggttctgcaagatcggtaaatctaccttctcttcccttgtactcggaatctactggacgtcccaagtaaaaaatgtgtgaatctatacatttagttaagtttgtattgttttctccatcctgagatagaaaacatggcttcttgcataaattgaagtttccaactcaagaacagcctttaaagaagctggcatgctgctcagtaactggggagttgctgccttccccccaccccctgagcccctggcacctagcagtgtttgttaatgaatcatagcagagacgtccatcttctccactctcctgccccaacccaggaacacatttccagagctagaaactacttactgcaactgttccaaaggtctgtgaaataaacatcacagcacagcagcattcacctgtgctatgtattaaatactattgtcagatatttagaagtctgagttctctcccttgtgggaaaagacaccgaatgtaggacctaaaataacctgatcctggaagagtcccattcgtttttggcctgatgctcttctttgggcaacagatctgactaggtgtctctggaccttggctgcacattagaatcacatggggatcttttaaaatccagatgcccaggctgcacctcagaccaatattgacatttgaatctctagaggtgggtccaggcattggtatttccccttaaaatttttaatcagaaaatattttaatgcacagaaaatttgaaacaatagtacagtgaacacccacctagatttaccaattattagcattttgtcacatttgctttctatctctatcctctatccaatctccacacatactctttttgattactttttttaatcattgggatttttggcgttttttttttttttttggagacaaggtctcactctgtcgcccaggctggagtgcagtggtgtgatcacagctcactgcagacttgacctccccaagctcggacaatcctcccaccttggcctctgtactagctgggaccacaagcacatgctgccatgccaagctaatttttcattttttatagagacgaagttttgccatgttgcccaggctggtcttgaactcctgggctcaagtgatcttcctgccttggcctcccaaagtgctgggattacaggtgtgagtcactgagcctggcctgatttttttccttaaacggtttgaaaataaattacaaacatcaggacacttcatccctaaatacttcagaatgtatctcctaagtatgaggacattctgctaggtaactgcgatagaattaacaactccggaaatgtaacattaacatgctattatctagaattagttcatattcaaatttccccagttttctcaatgtttttatagccttttaaaaatgcagaattcaattagagatcatacattatatttagttgtcatatgtctttactctttttaaatctagaataattctctagccttttaaatatcttttgtgatattgacttaagaaaaaaatatttctgtgcctagcttatttcacttaacataatgacctccagttccatccatgttgctgccaaagacaggatctcgttcttttttatggctgagtagtagtctattaggtatctataccacattttattttcttttttttaaataaattttatttttaatttttgtaggtacataggtgtatatatttatgggatacatgagatattttgatacgggaatgcagtgtgtaataatcacatcatggagaatggggtatccatcccctcaagcatttatcctttgtgttactaacaatccaattatagtcttttagtaatttgaaaatgtatgattaagttgttattgactatatcatcctgttgtgctatcaaatagtaggtcttattcattctttctaactatgttttttgtacccattaaccatccccatctcacccccgacctgctcccactacccttcctagcctctgataaccatccttctattctctatgtccattgggttcaattgtttggagttttagatcttacaaagtgagaacgtgcgatgtttgtctttcggtgcctggcttatttcacttaacataatgatctccagttccatccatgttgttgcagatgacaggatctcattctttctatggctgagtagcattccattgggtatatgtaccacagtttccttatccacttttctgttgatggacacttaagttgattgcatatctttgctactgtgaatagtgctgaggtaaacatgaagagctaaaaaggttgatctcgtggaggtagagagtagagaggttggttactggatacaaacatacagttagattgaaagaataagttctagtattcagtagcagagtagggtgactatagttgacaacaatgtgtcgtatatttcaaaatagctagaaaagaggaattgaaatgctccaaatacacagaaatgataaatgctcaaggtgatggacactcaaataccctgccttgttcactacacattctatgcatggaacaaaatatcacatgtaccccctaaaaatgtacaactattatatatgaataagaattttttttttttggctaggtgtgatgactcactcttgtaatcccagcactttgggaggctgaggcaggaggatcacttgagcccaggagttcgagaccagcctaagcaacatagcgagaccccatctttacaaaaaatacaaaaattagccagtgtggtagctcacatcggtagtcccagctacccaggaggctgaggtgggaggatcacttgagcctgggaggtcaaggctgcagtgagccaagatcacaccactgtactccagcctgggcaacagagtgagaccctgtctcaaaaaaaaaaagtttttaagaaaaaaatcagatgagttttttgtttgtttgttttgttttttttgagacagagtctcgctctgttatccagattggagtgcagtgggacaatcttggctcactgcagtctcctgggttcaagtgtttctcctgcctcagcctcccgagtagctgagactacaggagtgcgccaccatgcctggctaatttttgtatttttagtagagacagggtttcaccacattggccagatggtctcaaactcctggcctcaggtgatcctcctgcctcagcctcccaaagtgctgggattacaggcttgagcgaccatgcctgaccagatcagtttttgtaaacggctcctcattttaaatttgcatgattgtttcctcgtggttggatttaggtaaatgttgtggcagaagtattctataggtgatgttatagaagtattctataggtgacgatattctataggtccttctcagtgcagcctatcaggaggcacgtgatgtcaatttgtcctatgattagcaatgttaacttggatcacttgggtaaggctgtatctgccagctctcttcattccaaggggaccattttccttttgtaactgtggggagatactttgagatttggtaaatatcttaatccccaacaagctttcgcccagtggttttagcaaccgttgattcttcccagaatcaattattactatgatggttataaaatggctattgtctggatatttctatcatttctgtatttgtcaatgttcttttgttaaaaaaaagagaaaaaaggagctttcacttctcaccccataactatctatctgatcttctttagctagctgtctagctacctgttaaacatattaatatggactcatgaattttttaatgaatgtattgtaataaattccctcagtacataccgtattgtcccaactttggtcagtggaagccctgtctagctgactcctgtgtccttttgaaattatcccttaaatgtttgagtacttcatgaattttagcacaaccagatattttagtctcactttgtatcttctttgccgtaggcttagaagaagccatttttctatggagacctagttcctctggagctgctatttaggaaggcatcagtagttttgtgaaagctccctagtcgatttcaatatgcagcaaagaataagagacatagattagagtcttccaaggggagaccacctgttcccacaaggtgtttcttttcttttaatcacctgttatttgtggtgctgatttgttgctgagatttagattttcatgtgtgttactcaagagatagctttaaatgcaggtccctggccccaaccccaaagagtgagttcagtagttctgccttgcattttaacagtctggtgcaggtggtccccaggccatacctgtagaaaatgccagaagtaaccctggaaactgggaattaggggtttcttttgattttcctcttttgctttttatcagtggtttctaccttgcaatatgatttcagaatactgccacgttccccaggtatgtggtaaggatctaattgattaatttgatggattctttgaaaatatcagatgatttaaacccttgtagctttactcttgttccatcatggggaattggggatgtgaaaaaaagaggtggtggggtgggggtggggtgggaagctttataagtgttggaagttttcagttgacccaaagacttttttcatccaatacattatttgttgttattagtttattttcacggacactgaatgaattggcctagtaaagttttcacatgctgtaagatcctaggatgtaggctctaaaatatagttgtgtgtgctgttttggggactgggtcatgacaccgtagtcagtttctgctatttccttttctgagaaggcaattaattgcattgcctccccatccaaccagctttattttattaaatctggggcctgtagggcccaagtgcccagcagctgtaaggaaaagctcctgatttgtggtttttcccttcctggttccacctttcaaacaaataccatgttagtgcagctagtcccttctgtgatctcaagacccaggactgagaatgcttaagaacagtcagatgtgggagggagatagtgcttctggagttgcgttgcctggtttgaaatcctctggtaaaatacatgatctctatgtgcctccgaggtcttcttgtctgtaaaaagggggttagtaatctaccccagaggttcagtgtgaggattaaatggggtggcatatgtaaagtgcttagcagtctatggcacatagtaggtgctcaataaatgttactattttattaaacagtaaatggtcacaaatggaagggggccgtggggtctagtgagagagttgagggtgtgctgtctcagttatcattagatcggctattgtggtatcatagtgcttgtgatcaacgaacccttatttcacttaatacagttgttcccccttacccgtgggtgctacatttcaagacccctagtggatgcctgaaaccatgaatagtgccaagtcctatatatactatgtctttccctatacgtacatatctatgagaaagattaatttataaattaagcgcaggaagagattaacaccaataaataataataaaacactaataataaaatacaacactaacaatatactataataaaagttatgggaatgtgttctctttctctttctcaaaatatcttattgtactgtacttagccttcttatgatggtgtgagatgataaaatgcctacatgatgtaatgcagcgaggtgaatgatgtgggcattgtgacgtagcgtttggctactattgaccttctgatgatctatgagaatgaggatcatctgttttgagtgatcctggatcgtggagtcacaacgctgtctgtggttagatgtgaggagcagacagtgtcagtgactcaggggcagggaacatccgtagcgtggagacgctggacaaatggatgattcacatcccggacaggatggagcaggatggcatgaggtttcatcacactactgagaatgacatgcaattgaaaagttatgaattgtttatttctggaatattccatttaatatttttggaccttaggtggccacaggtaactgaaactgcagaaagtggaactgttgataaggggggactactgtaaaaattccactcccagttcatttggacatgaaggtggtggctcaaactaaggaattccaaacctcaggcataggcaagtcataagtttttttcctttagtttatgtgagctattgaaatgaggtggcattgtcatctccttacctctttaaggaaggtcaagactcactagtaaacaccagtgaaattccaggagaggaaaaaaatgacaaatgactttcttagacttccttaagtttaagatggatggatgcaactgaaatacaatttctcccaacttcaagcatcccccttgaactgggttgtaggtcaggtggtactggcaaacaaattcaaatcagtgacaggctatagttgaggcctcgaaaagcagcattccaggagtttggtgttctctgtaatgagaggtccatggcagagacctaagtgacgtggtacagtgttgcaggaagaagttgagtacagattgcagagagtttggcacaaaatgtgaattgaattagtttatccagcactagagagagaactatgaacttaggctaaggaaatgctgccacttactagcttggtgacctggggtaagtcattgagtcctggattcctcatttgcaaaatgattgcccattctggcttttattttttaactcatgtggttggcaggaggagagggtgatggatatcagaagggtttgtgagctatcccagtgcgagggcgaatgattgtgcttggcatcaggtcacgtgatctttaccaccagccacctctgggtccctcccctgtgccctctgtagggcttactctttggcatgttggcagtgagctttgtaggactttatgctaccaaaacagtaacagtcatgaggctggactagcctggcagagagaaagtagcgaagacatcattcttctgacaccaggcaggcctttatggaagtccgatgcggggatttggtttaagagcagtctcattattctgtttcaggtcctacatccattgggttagtcttttctctaagaatagatcactctctcctttgccatttgtgcagtgttggattagatgctactttttacagagggttttttgaacatatgaacttacatacaactgtaagttttatggcttcagctaacactagatcttcagatggtgttattttaagtcactttggtcaggactttgacttctgtggttgtgagtgttggttttcagacgtttgtcatttcacttgtttcatgttcagatttgtgtctgcagagtttgcttttaacataacatccagcaaatgaaagccctttaaagattggtagtagaacttcattttaagaagcatctatggggccagtggagtcgcaggggtcaggagtgggatgccaagattgccttgtaatctagactttctttgctagaatgagaaatccatatcctttatggtacagggtacttgatttgccttccattgtatgggaagccatggtatagtggtggcgttctttgcatcggaatacccattcctcctgactttcctccttggaaaagcaagttggagtgggccctctgtcctagggagagccaagccctccttggggttgcactactcagcctgctgacagtgccatcagcatctaggaattgccctggaaatgctgtgtttgttcctaagacccagaggcttgtaattttgcacaaaggggtggagagtatttgtggagtcaccaaagatgtgattagacaagatatcgattctgaacttctgccctcttccttctattcaactctgttcttgcttagtgaggtacaggcaagaaaaatggaacagagagaactaggctgccggcttttgaaacatattgatcagggcacacatccgatgtagcacagagaccttcccctttatatgatgtcatcctgcattggggccttaatgtgccctgtgatcacctctgcatggacttcctttctcagagaaaagattagagaagaaaaagaatccctgtaggcagtgctaaaaaataatttaagcatttctaaatgtgtttctttgaagtcattgatccctttggttttctaggccatgcagtggcatgaaggaatggtgtgaggcggtcagccatgaacgacaaacttctgagcaatgtcggtctcacttcctacctcccatccacctccctggcttgggcctccactgctgtctgtctgtctgtctgtctgtctgtctgtctgtctgtctcaccctcacccccatacacgttctttctccacatagtgcacatctgtggtgtggatatgctgtggacagttgtgtctgtacttgaaccagctctaagccagggtctcccagataggacatgctgggtgagtgagatgttgtaaccctgagtgtcctctggttgagtgaagtgtggccctggctcttatcttgatttgtctggcttggttctgcgtaagtagctggggatcctgttaatggatcccctgggacagagggaagaggacagaagtagatttgttgaatcctgtgggggtgtttgaaatggtaccaagagcaggctgaaatctaatcagccttcacttatcaggcttgagttcccgtatgttgaaagggtgacgattagtaagaaaaaggccaggatactttatctttcctttgcacatttagaaaaatcccctctgccttgctagcattagaagcagaccattcttttttctctaccacatcacatcagcttccattaaaaatcaacagcagcaaatacaaagccccatctatggaaaaccgtttaaggcaacactgtgctccagtgcttcaggggtggggtatttgccttctgcaccaatggatcggtttctcatatccatgcctttctgacccagcagcttttaaaagaccaagaagcattgctctgctttctactgcctctctctaagagaccagggctgccgtgcctcaagccatgtcccagagagcatatttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaa

SEQ ID NO: 3218 - DNA, 353626 bp, human
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatgggtgagtgggggccgcccgcgtccgggcgtccacttcagccttgagggcggcgcgccagtcccagaaccgcggagcccgggagggcgccccgggggcagggtccggacgggggacaccgcggtgggcgccctcgcctgcctcgcgcacccccattcactcccacttgcgcccgtgtgcccgccgagcccgcgcgcggcgccgacgggaacccgcgggggcctgagcagacgatcacgggggctggccccgggcggctcgggctgagggatgcagggggtgtggttggtttttcgggtgggcggggagagttttgtcttggccatttttgcacccgagcgcgccctcctctgcgctgcggacacgggcacccggacctggtgggctccggccctgcgcggggctgctggtgtcttcctggtcctgtctcgggggaagctggaacctcggggtcttggagggggctgggttgcctttgctgggggttgacaggggttggggggtggggcgggaaacgccccagttcctggtctggctcgcagtcccggggtccagagcacctgacgctcctctccttgcgccccccttcctcccggccccgaccctttcgctgctgccttcctccagcctggcgagctctctgctccgtgatgctaaaaggccacttcccatactgtcctttaagtcttcagggtctgggacctggaaatggtgatccggtctttgatttactgagtaaacatcagttcgaagtagccaactaacctttgaaccccctgggtcccatttgatttagaccccggagcattggaaccaccttgctgcccagagaagctgccactttattggcaaggcacttatgattacttgggctattaaatgtttggtctacccaggtaatgttcttgctgacagccagcttctgtttttcagcctctggcagattatttttggatgttcctaggccaggcataggaaggctgcagataataataaatcataataaagtgagacctttctgtgttcaggtaataggattccagtacactagtcaggatgttcagaaagcctgaaggattggaaaagaggaggtttaacccagtccgttgttgacaggcaaagttaaaatcccatttgtggtcatttgccaaaaaaggttttccttttctaagtagtggtgatctgttgtccccttggcttaaatgtcacttttttcacagtgcccttctctcccacctgtagtctaaattggttcctgttccattttctcatacaacacctttttttttcgtagcagtattacatatttgtgcgtaacagttatctcctctactgtaagctctgtgaccatagggacagcacagtgttgcatagtttgctcagcacttttggtgtgtggcacagagcaggacctaaatatttgttgaatgaatgaatgaggggcatgaaatcctcctcctctgctggggacagaacacttagctcactcttgttttgctttggcccataagatgatttagttcattggcagaagtatatactttaaaccttacaggccactttagtaatgggttaatttctcccgaggtaaccaaaaattctgttttgatcacctttcattttgggtgggtcaccgagagggttatgcacaaaaagaagttaatccaaatgtcttctcccatggccagactgtgctttctgtatctcaatgagaaggggactgagtctcatttaagaagaatcagacctatttttcagatttgaactgttttcattcttcagaacttcctacgaaaaatagagtgctcctgtagtttttagtccttttgtacttaatctttactgcaaccattattgcagggggagggggcatcgattttcatttatttcaggagttaatacttagaggtgataatgtcaaaacgaatgtaatttaattcatgtttatagtgggatttaaggtgcttatagtagtttgtggctaaaaatcacctgctcttttgaaagcatctccagcagtatatttgtaatgaagtgcagttatttaacggttcattctgtatgtcttccaatggagtgatctaatgggctgaggttgtgtgtatgcagacagaggcccaccctttcccccaagtctctggttttcagatttatccagtttatcaatttgatgcaattttattcttttttaagagggagggtctcgctgtgttgcccaggatggatttgaactcctggactccagatcttcccaagtagctgggactgcacgctcacaccactgtgcctgattctgatacacttatattcttacctggcctgataatgagttttctcttgatggataacatagtaaaactgtatcttatatttcgttttctgaaaaataacagaaaagaaccaaatccctaaccctgaagtgaagctggttagttgcaacatggcctcttataaaagcccatcagaatgtgccctctgaacttgctaggagatgcatgcctacagtgccagacacagagaaagcctcttataattacaattaaacagatattatggtgacccaaatctgtgagtagtgaagggtttgcaagcccacaaatgatttctgtttaattccagagtaacaacaaagtttggatagcctttggcaatgtatttattgtattggcggtagactgctgtatgctaaactaaagctaaaatgaacataatgtgttggtctgtacaaatgtcttgagttagaaatggaagaaaaggctcccaccttaattgtacataagctttacccacttctatccatcttggcacgagcaaaagcttgctgtggctctggttacacaaaccttggtggtttcttctcttactacttcagttcttttggcgttactgacattctctcatcaactcttgagtttgtagttgtttttaatgtattttgcatacagcagtatttgttcatctatccatccatccatccatccaatgtttgttgatcttctttgcataggcactgtgctaagaacaggtgcagaacagagacatgacactttgggcttctcagtctaatgaaggctgacttgaatgcaattctcatggcagtatgtagctgaaagccatagtagagcgcatgaaagatgagtggagaaggccaatctgacttagcctggagagtgcccaggacagtgtcttagaggagattgtgtttgagcagaaatctggttgagtatgagtcatcactgccctccagccacacctggttcttgtggcagagactgaaaacgagcaccgtgggaaccgcggggcatctcagtaagatggtacaaggaaggatgacttagagggcttgcacctgtgtcaggtggcttgagggcgtgtttaaggaagctgggcattactttggattggatgctaccagggggaatttgtgattgggtattttaacaaatgttctctaggagcagggaacattggaggcaggccacagctatggttggtaaagcagcagcagtcatttgcattatccaggattgggggatatttggtcatgtgtgtggtttggacaaggtgcatgttttgtccgtgttcagacatgattaatgtgtggtcttgttttcatcttattccatcctggtcgcagagtggccttgtctgatgttggttttctagggaattgtttctgttcaacaggacaccctggcccagctgtgggtgcctggccagctcccagccagaagaactgctctttctccgagttaactatgtgacaggcaggggcagggaatcggaggcagtgggggaggaaaatggctttctaggtatatctgtggctacttcatatcaaccaggtatagcctggactgttgttcaatgctaagcacgatggacatctgaaatgctatactaagggaagagagagtgacagagaaagagcaagctgctgagaaccatgaagtcagtgctaatgggaaagacgcagaacaggaaaatagcccaaatacttagtgttagagaaggagagcctctaatgcagcgcttctcagagggtggccccaggccagtagcacagcctcccctgcaacccgttagagatacagattctctggcttcattccagcagacctcctgaatcaggaatgctggggatggggcccagcaatctgcattttcatgagtcctccaggtggttctgatcatagtccagtgtagaacccctccttgccttacagttgagaaagctgacatccggagctcgtggttcactggggtacacaaggcactctgttcataagactattataagtcttatgttataagtactgttataagtgactcattaccttagaggagaaagacatactcctacttcaaaacacacttcttgtgttaagacagtacagtgtggattcttccacgaatccagtccaacccagacctccaacacctaggcattagtgacactaggcagccgatctcagtgttagtctctgagacttttaccagagtatcacacaggcacttcccagcatcctttaccctccatcctctttaaaggggactttaagttacactgtttgcattattccagggtgtaatatttgttcatgattttctatacctggtacctgtattcgtttctgattgctgctgtacctaccacagacttagtgcctggagacatcacatgtttatcatccgtcactgggcgacaatcacgaagtcagcagagctgcattccttctggaggctgtaggagggaatccctttccttgccttttccagcttccagaattggcattcctttgcttgtggcctcttcctctctccaaagccagcaacggctgggcagctctctctcccatcacatcattgttactgactcttctgcccctcttttccatgtgtatggactcctgtgatgacattgggtccacctggatattccaggctcatctcctcatctccaggtcagctgatcagtaagtttaactcccctttgccttgtaacctaatattcacacatcctgggctttaggatgtgggcatctgggggcggggagggaatgttattctgaccactacactgccctgtggtggacctgacgtttcctggtttctcttggataactgtgtgttcatagtcaactgccctgtccctccttgggaagattccatctttggttctatttagatttttacagtttattaataaagccgccttaaagttacatcttgcattcacctttcctcttcactgctgtttttttgagacagcttgtcccactcttcccctttcctcacatagcctgccctacacctaccaggactctggcactgccttgattgtgttctagaaactgatcatgctgaggttatcctgaatgatccttctccaatcacgaagtacatggtctcaggcctcaccatgtttgacttcactgaagcttgagattgaagactggaagtctttgtcttctagaacaccctattttttcctgatttctcctacagtcctcccttcttttcttccacccctgtccacctgtggaatgctgtcatctctggtccccttatgtttagtgtgtccttgagtgattgcagccactttgccaattcaggtgtcgcctattgacgatgcccacatctgtccccagtcttggtctctgttctgagctcaggacccacccactataagcaccacaagggcaggaacctcgtcagtttggtcattgtgttcctgtgcctggtacactgtaagcctaagattaacattggttgagctgattatcattggtatcctctcctagctaacttcacccaggtgtgtcttagacgcctcagactgagcatgttgcaaactaagcacagcatttctcctctgtaatgcctgccctgcctctttttacttcccatttcattgagggtatcaccatctttcctgtcacttccacagggacgctgctattgttccttgcctcttgttccttcccctttccctgccccttctgatgtacagtcaagccctaagtggctctggaattgaccctatgtgtctacccttctgcaaatgctttagatcctgaatgccttagtgaagccttcgtgaagctcggcagccaccaatgctttcgcttattctaagctcattcaggtctctgagactttgcccacgtatttcccttcatggggaacagatgtcactctctcctctgccttgtagactccctgtatcagtttcctattgctgcagtaacaaatcactgtgaacctagtggcttgaaacagcacaaatgtgtaatcttatagttctagaggtcggaagttcaaaatggatcttaccgggtcgatatcaaggtgtcagcagggttgcgttctttctggaggaattcatttccctgccttgcccggcttctagaggctgcctgcagtgcctttacctccttcactcgtaccccagccctccaacctctgcttcagtcctggcatctcctatctttcaccgagccacctgcctgccttttatgaggaccattgtttgacactgggcccacctggataatccaggatcccctccccttctcaggatgcctggtgaatcacacctgcaaagttcctgttgccatggaagggaacatagtcacaggttctggggattaggatatggccatctttgggaagtcattgttcagcctcccacaccgcttgtgcatctgtgggagcctgctccaaaggtgtgctgtaccatactttgtttaaaacattttttatttttaatttttgtgggtccatagcaggtgtataaagttgtggggtacatgagatgttttgatacaggcatgcaatgtaaagtgatacaacatttcctcttgtattaagtctccatctccaactggatctgctcagctccattgccctggcacattgcctggcatacagtaagtgccatatgttaatgaatgaacatgtaaccctttcacccaaatacggttacaacttgcaattctccacgactatggaccaccaggagtgagtgtgcaattctgtaaagtcccctgggcagagcatgttgacaaggtctgtttgctgacagttcctggtggcccacactgtagtgggtgagaagggtgatgccacatgtattacatggctttaacaaagaactgcacattttaagatagaaaattctctctggcagtggttctgaactgggggcaattctccccaccagggggacacagcactatctggagacacttttggttgtcacagctggtggcgggggtcaggggagtggagagtcattctactggcatctactaggtggaggtcaggggtgctgctaaacatcctacgatgcacaggccagccgccccccgcaccaccacaacaaagagttatctgaccccaaatgtcagtcatgctgaggttaaggaagcctgctctgggggaaccccgggggcttattaacacagatggctggagcaccatttccttacttcattatcagtccttctggaacataaggctttgtatgtaaccacagtcttcgttttatgcacgaacctacaagtcactagagaacaggactctttgggactttcaccattttgttctttgaatggagagtgtcttaacacaactcttgcctctcttccgttgatacctaggtagttaagctggggagaggcaagggctttggggcacgaagttgttaaacttgcttctggtagtgtttggcccctgtaatgttttgtctttctattgggatgtgcttttatgtggggggacaggcgatgggtcctctgctactcacatattggtccctggcattgaagtgctggaaggagccttggcagtcatggcccatgacatcagatgatgagactgagcctcagagaggcagagtgacaatggtcccctagtggtagaacccaactgccttccagtatggaagaaccagccccgcccaatttctgtaggtgctcagaaaatgtcaggctcctgcttcccctcgtgaggctcttgctacagtctctttccgtagtaagttttttattttttattttttgagacagggtctcactctgttgctcaggctggagtgcagtggcgcaatcaaggctcactgcagcctcgacctcccaggctcaagcgatcctcccacctcagccacccaagtaggtgggactacatgtgcgtgccaccacgcccagctaatttttgtatttttttgtagagatggggcttcgccatgttgcccaggctggtctcgaactcctgggctcaagtgatccacctgccttggcttcccaaagcattgggattaggcatgagccatcacaccagggtgtaagttttttttaaacagatttattgatgtataatttgcataccatacaatttatccatttaaggtgtgcaattcaatgggttttggtacattattaattttatgctaaaacatgtaacaaaatttgcaattttcaccacttttaagtgtatagttatactgggtatattcacaatgctttgcaaccatcaccactatctagttccaaaactttctttttttaaaatcacccctccctagtaagtttctaacttgaaggtcagaatccatgtcccctgggggttcctggaccagccagccaatttggagaacacttggaagcccaaggatcccagttgagattccaaaggaagataggaaaagggaaagcgtggctttttgtgtgtgtgtgtgtttttggttgatatttccttgggaggccctttattttctctctctctctctctctctctctctcacacacacacacacacacacacacacacacacaaattagccaggcgtggtggcacatacctgtagtcctagctactcaggaggctggggcaggagaatcacttgaacctgggagcaggaggctacagtgagccgacatcgcaccactgcactccagtctgggcaacagagtgagaccgtgtctcaaggaaaaaaaaaaaaaaaaggtctacatcatgggagaaaacactgcagtgccaaacagatccctcgaattcacacacatggttgatatcattccacgtttcttcacttaaattccttcagctggcaaaggtccaccagcaacctgtgatcatgagcacttggttttcaacttgatcattatcttatggataaatatcttgcaggcagttctgtagttttcattaggggatgcttaaggcaaaaggtagctcatgggtcttaactctgtggtcaactgtgcttatatttagccttacaaagaaaaaacactaataacaaaaatcctgtgatacttgtcctaacggaatactatccagttggcaagaaaagaccagaaaaggcctctgcttacttcctttctgtggccacggaagtggtgggggcactgctggaggctggtccatctccaggtgtgggtgacagagtggcaagatgaagtgcagttcagttcatactgttatttctatcttggataaaatactataaacatttcaatgcttattaatgactcatttggcataataaatttaagtccttgagcacccaagtacagcatgtatagacagtttaaacaaccatctccttacacttgagcttcttaccagccagtatgcaaacaccagcccttgtgtttttgccagatttttctggactgttctagacttagaagacttggggccatgttctaggtctggtcctctggggctgcaccagttttagccatcacatgttacctccccatgtgaaaagtctttaattagcttagtgtcctgtctaattattccagctagttcttaggtttgtgcctggagctagacggagacgcttggccctcattttggatgaagactgggaaaggccattcttgctctgctgccccctcctcttagccagcatcttcatggacctcaattttcttcaccagggtgttctgggtgctgtcttttgatgagcattttacataatagcttctcaaattcacttgacagaagtgacttcgtaaatgaactttgcctttctcctgttttgatcatcaaaacaaaaccagcaaaaacatctcttcacaacttgaccgaaatgggacagttttaaaccacttagccagtgatttctaattacccctttgttctcaacaaactattagatggcaaagagaggtgtcaactcaaatacagtaggtcaatgagctcatctgtgatccatgaagcaggatggacagagtaagtgtttgttaattgatggtgatttttttaaagcttaattgctgcttttggctgtcaggaaacaaatgaaagtaattggcttgcggagggtggattgtggggggaaaagtgaggtggaagatttcaccaattgaagaaaaaattggaaagggggaagcagttcacactgtcttcatctgttttctggggcataatgactacagctgcttgcttgagacatttttaaagttagtttttggaataggttatatatccccaggattcgaaattcaaaaggtgaaaaagtgtttacgggaaaaagtctccctcccatctctgtccttcagctatgcagtgaccctccccataggctgctgctattttgtttctcaagttttcttccagggagctttcatatgtataccaacacagaggcatttctgttattttcccctccttttttaacgtcctgattaattgatgatgggtgaacttctgtctagctggggattttctcccccccggagatgtgcattggaacgctatgcctagtccttccatctagttttgatggagggataggtggacttcggaaaagttctccaggagactgctctattgtcctgaggctcagctgatctgggttattaattgacagaaactttgtcctggatcttaacccatctaggtgttttttttgtttgtttgtttttgttttcttgacagagtctcactctgttgcccagcctggagtgcagtggtgtgatctccgctcactgcaacctgtgtctcccgggttcaagcgattctcctgcctcggcctcccgagtagctgggattacaggcatctgccactatgcccagctaatttttttgtatttttagtggagatggggtttcaccatgttggccaggctggtctggaactcccgacctcaggtgatctgtctacctcagcctcccaaagcgctaggattacaggcgtgagccaccacgcccggccttaacccatctgggttttgaactcaggaacagtcttcccactttcatgttgtatatatagtaaggactttcttcaaatgatagaagccaagcagggcccgctaacctgagcaaaagggatgcttattctggggccacagggacctctcatgcaacccaagggtgcctgctggaggagccggaccccaagaagcagcagctggagctaggtgtgggccagctgcccagtgtgccctctggccatgcttcctccctgtcccctttcttctgtgtgacttgttcatggggcacatgccacagttccaaatgcctgttaagtgtgacttgatttggtcccagttccacatttttgttagtgagactgagcccaccggagcttctgtctcctcccacctccaccctccatatacacaggtggctgctccatgcccacatccatggtgggcgggaggtgctcagttccagtcctggtgtaaatgttgaaggagggcgcatggaggacccaaatgaagccctgccctgtggaggagtgggtgctacggggctgccctcgggccaggcactctcagtgaggatgctagaccgcctgccagtgttggcattcattttccctgccctcctcttgacaaaggagtgactgatgtgaggccgtgtggcctcttctgtgctctagccatccaggatgttcattccatcctcacagagtcccttctatgaggctccctgaggaagggcccttgtcggagccgagaacagttgtgcttcagagtaatggggctattttaatcctttgagctcctgaactgtgtgactaagctccatgtcacctattgagttggcggccgttaaaaagtgtgtctgtgcctctgggggcccttggatgggttggtgatagcatgccatgggggaagggtacagttgtgacatcgtctggcgcttttagggaacctgtgggtttttaaatggaggaagagatgtagacattgtaaaaaacagccaccgcctgacgagttaacccctgaggtagagatgcgctccagaaagcgggcagggggctctcgccctaatgcctatctcctccctcctgccttctccccctctttttctcctctctctccccctaccttttctctctctgctctttcttcatcccctcaccctttctctcatccctcactcctcttcaccctgtctccctcactttctctcatccagatccatctcccctacgctctttgtccccgcatctctctcccattcccctgcaccccctctccccttccaccctcttttccacaccccttctccccacaccttctctttccctcttagtctctctccccgcatcctcactgtccacccccagcctcctgaccctccccacttctgctctcccttcctctcagcccctctgtgttttgcccctttcttcccagcccgttcctcttattttctctcttcctcacccctcctctcctggcccctgtgtcttacccttctcattgcccacatcccttctccactgcccccttctccacacttcctctcctgttcttactaagcccttcttcctttcttcttccccctcctgcctctcttctctcacccctcaacacctccacacccccccactttgcccccccaactcttcctctcctctctcccatcctctcatctgcccccaagcccccttttctgtctctctgcccacttctttctcccccgaccccagttctctccccggaaccccactctggccccagtgcccactctccctcaacccctcttctctcttgcacttcctcctccttcccacattctcccatttcttccttcaaacccagtattgctgcgtgcctcagattttcaatcccacagggcaggaagagccagggacagggttactggccttctccatcccacagccagccatgggtccctactctagaataactgtgatttttattttagtgtacttcttttagagttttatatatatatatatatatttttttttttttttttttttgagatggactctcactctgttgccccggctggagtgcaatggcatgatcttggctcactgcaacctctacctccccagttcaagggatccccccgcctcagcctcccgagtagctgggattacaggcgcacaccaccatgcctggctaatttttgtatttttagcagggacagggtttcattgtgttatccaggctggtctcgaactcctggcctcaagtgatccacccacctcagcctcccaaagtgctgggattacaggtgtgagccactgtgcctggcactatttcttttttcttatgaactcctcttactatcattcccaaatattttggtgtatttctttttaggttttctttatttttatttttattttttttgatagagtcttgctctatcccccaggctggagtgcagtggcatgatctcggctcactgcaacctctgcctcctgggttcaaacgattctcctgccttagcctctcgagtagctgggattacaggtgcctgccacctcgcccggctaattttttgcatttttagtagagacagggtctcaccatgttagccaggctggtctcaaactcctgacctcgggtgatccacccaccttggcctcccaaagtgctgagattacaggtgtgagctaccatgcccagccagggtttttactattaatatatacttgttgctatatgtacatgtattttatatatacatgtatatatatgtatatgtatatatatatatatatatatacatatatatatatatatgtccttgttttttccacttcatagtcatctttgaagccagtgtttttagtagctgaatatttgagttcatgcatcttaatttatgtaactatttccctgtcatttgagcatttaggtagcttctatgatcttgatattatatagacgaggatgtgatggacatatgtcccctttctatcctgtaaggaaatcacactgtaggcagtgtggcattttatatccattctttatctccatagatgcccaaatgactggactggcccctgatgatgagaaggaagaagagttcagtccaagggaattggcacatgggaattggcagggtacttgtcctccatgtgtttgctttcagttttagttctagaaactctgtgttcatatggcttatcatcccttttatatgtgctctgtgtgtgtgtgtgtgtgtgtgtgtgtgtgtgagagagagagagagagagagaagagagatggagacagatcaactgatacttcttttttttgagacagtcttgctctgtcgcccaggctggagtgcagtggtgcgatctcggctcactgcaagctccgcctcccgggttcacgccattctcctgcctcagcctcccgagtagctgggactacaggcgcccgccaccatgtccagctaattttttgtattttttttttagcagagatgaggtttcaccgtgttagccaggatggtctctatctcctgacctcgtgatccgcccgcctcggcctcccaaagtactgggattacaggcgtgagctaccgcacccggccccaactgatacttctaaaagcaactgcatgtgggcttttatgttccacagcactgtccctatttcactgcaccactgtggggcaattaatcctggtctcgagttcaggtgtaagattagaggatacacagtgaaaggtgaaatccttgggggtttggttcctttgttttctctcccgctttttgccattctttttctttctttctttctttctttctttttttttttttttttttttgagatgaagtttcactcttgttgtccaggctggagtgcaatggcgcgatctcagctcactgcaacctccacctcctgggttcaagcgattctcccgcctcagcctcctaagtagctgggattacagccatgcgtcaccatgcccggctaattattgtatttttagtagagacagggtttcaccatattggccaggatggtctcgaactcctgacctcaggggatccacccacctcagcctcccaaagtgctgggattacaggcgtgagccaccgtgcccggccaccattcttttacctgactgatatttaagggaattttgtttcccagaaccatagggaaaactgtgtcctgaaggccctgagccatccatgtgacttcatgtttggctgagataggggtccaagtcccttgctggcaagggaaaggtcgtggctgtaataatccccttgtggtttctagcttagctttgtgtcatcatgcactcctctgaaaaaattgtgctcttagctttaaagggcaccacgtaagggtggctagaacccccaggagccaggctggatgaaccatctcaacgccttggcctttttaattcatcactttcagtaatggacaggattgtggaaagtattcattcttcagccaccaagtgtacgtcaaatgtcagctcatgtacctgttaaaaaaataagttgaatatttatgatgccatctcaggggcaagtttcagtgaaagttctaaagttcatgataataaatgttagaaagcattggtgctaatatgtaccatatactttatccctttgttaccttttcaaattgtgaacataacctgacttgaatttgtaggacaaacaaaacagttgactcaatactgctgtgtattggaattcaattaaattctagaagtgtttattgagtgcctgttaagcataagatctgataaccaggggaactcctcaaacatatctagagtttccctcaattgttcatttttcttaactttcatttccctaattgggtgaagattgtgatgtggtcattttatgaatcgcccaacaaaataagcagttaaaccaaagggtgtttgtttgagaaagttctatttatccagaaagaaggaaagatataaattttagcaaaacacatcaaattagaagacagctttgtgagatagaaaaatgtctagtcagtctctgaaactccctcctcactggtagtttagagagaaacaaaacagaatggggtttctcaaatgagtgctaaagttcccctcacaaggaaaacatttcccaataattcctgctttgccttaaacccactaccatgaagatcagcagtaacaggagacacggcggtgtgcttcggccgtgaggttgttgcttggtgatgtgacaggcacatactgcttgctctggtgcggtcttttgtgttcacttgcttatcccatctcttttctctcttcaaaccactgtgagaatcccttcacacagttctctctgaggccttctcatgtggtgctacacaataaaatcagttctggaagctgatatgatagttgatgtcatgtctatgacatcaaacatcattataaaatgtatagtagtgggctgggcatggtggctcacgcttctaatcccagcactttggtaggacaaggtcagcggatcacgtgagcccaggagttcgagaccagcctgggcaacatggcgataccctgtctctatttaaaaaatacagaaaattagccaggcatggcggcatatgcctgtagtcctagccacccaggacactgaggtgggaggatcacctgagcctggcaggttgaggctgcagtgagccatgatcgtgccactgcactccagcctgggcaacagagtgagaccccagctcagaaaaaaaaaaaaagaaatgtgtagttgtggactcatctcttgatgtaagaactaaaacactgctccagctctgtcccctccctcctctttccctagaggaagcaaccaccctaagtctttttaaaatcatctttcttcttttttaagaaataattttatcatttccatatgtatctcttaaaaacaaacatattgtctggttttgcttgtttttagttttataaaactgggaccgaaactgcagagacttgtgatttgcttgttgtctctgattttgcagttcatgtgtttttcctgtctggtattccattgtttgaacatgccactgtatacttaccctttctccccgatggacttttgctttgcttccagttttttgctgctatgtacagacttcccatcaccatttgaatgaatgtctctggtgtatgtgtgaagtgtatttttttaaatgtgcatagcaaggagtggttttgctgggttttaagttgctggatttccaaagtgttgtgccagtatatgttctcaagaactgagtgaatgaacaaactaatgaatgaagaagataacatattcatggaaggagagagtatatgaatattcagctttagaagagaatgcctaattgattttcaaaatatgtgttcctagagtgtaaacatctctgctactccctgttctcgccaatatttggtatcccagatatattgggatataggctaaactgccatcacagagaccccaagacagcatagctgtttccttctcaggctactgcctcctgaccactggactggtcagggtgagtgaattgctttgctcagattccttctctcttgtggacatggtcggagctggctcaccagcactgtgtccacctttcagcccatggcagagggaagtagacggggagtagcttctcttcgttaaggacatgacatggaaactgcttacatcacttccacccacaccccattgcaaagaacttagctacagtctcacacccagctgcaggtgagtctgaggaaacaggctccagctgtgtaaccatgtgcccagcaaaatctgaaggcagaggagtattaatttcctattcctgctgtaataaattaccacaaatgtaatggctgcaaacagcataatttattgtattctagtttgtgaaatcagaagtccagaatgggtgggcagggctgagtgccttctggaggctctaggggaggattcctttccttaccttttgcagcttctagaggtcaactgcatgccttggcttctggcctcttcctcacatcaccctgacccctcctcccttcatctcatttccttttccggctcttccatcttttaaagatccgtgtgattacactgggatcagccagttaatccaggatactgtcctcatgtcaagatccttaatcaaatctgtgaagtccctttagccactttaggtggcatattcacaggttcggggaattagggcatggacatactttgtggggattggggagcattattctgtctaccgtaggggaagggatgggttctacagacagtccctgacttataatgggttgattgaatggttttctgattttacagtggtggaaaaatgacatgcattcagcacattcctcatcatgtccccataaacccatcgtgagttgaaaatatcctaagtcaaaagtgcatttacaacttaggatattttcaactcacgatgggtttatgcagatgtagccctgtggttagttgagaagcatctgtattttttaaaagaggaaggggataatgggtactagagagaatgatcagtttctgccatatcataccatcgcatttttgccaatcacatggctgtggatatattttaagtgttaagttgtcagaactggtgaatttgctgaagagaggactttgttttctgatactttgtgattgtcgggattcaaatgttgaagtaatcctaaaaaacaaagcatatttttgaggtctttctcatgagtgacaatttcatccatcagtcttctgtttgccacagtccttttgcggagggcattcccatccactgttgtacttgtagcttcctcagcgaagctaacagagcagctagcatccctaggattaaatgacaaggtgcgtattaagatcccggcgcacagtaggggcccagatgtgttacaaataaacaataacaaaagcccacactagcacatcgtggccagagccgccttgtgtgcaataatcacctcatcatacattgcatgcacatagtaggtagacaaatcaaaccctcctttcctaataccctctggccctccagcttgctgtggactggacgtttgcatccccctcctattcattcctgtgttgcagccctaatccctcatgttgtgttatttggagatggggtctttgggaagtcattacaggtccctactcctttaggcagctcgatttagaagtctttttcttttttctttcatcaatttttttttctttcatcagtcactttcttctgataatgggggaggttaagtcgctaatttgtcaaatttatgtgcactcatttttgtatataagataggacaaactttctgtggtgataacttaggagtctgcaggggccagcaagactcatttgtcctttcctggatccagcagcaccatcctcggccccttttcattgcctccctgggcttcactaagactgtgcttggacccttccttccttccctccatgttgtcctaggccctgtcttgagaaatcttggctcttagcctggagctgacaaattcttgcttaggaggtggaagagaatcgcatgtctgactaaaataattcatacacactgcagttgcaatttcactttcctggggtttataaacaggaagacaccaccaattggggatgagttatttatttttgaggggggttcgtgagacatcttatttatctttgttttacttggtctgctggaaaatgcaaggaaatccgatttgttgtagccagacataattccctcttccctttcctccctccccacccctaacttggctgcttcctgaagcacaggagaagggtcaccacttgaggagaaggcacatgctggttcaggaagccccagtgggttcctgcaaggactccaaaaattatgctctgtgagcactagtttccctggcgcccaggccaagaccacagccttctcaggtcttcttgtctatgccggtatcactatgcctggcacagtgtctcaccaacaggcagcgaaagaaaaattttgttgaaagagtgaaaacaacatgtgactttaaagccagagcctcattttccccaaccagttcagaaatttaatgggatcgcatattgacttctgctcgagtgcatgttggctatggttgaggcgaccgagaaagccagcactactcagttttccctgctcttggccttgtcgtgttgtaaggtctgtttacgtttggatagtatttctctcaagaggcctaaaatataggtaaaatcatcagtgacgccatccatgggagaattttggcaacacaacagcatttgtgcctagaccacttctgctgtatgtatgagaatcttcctgtggcctttgattagccgttaacagaaatttcttttttttcttttctttttttttttttaaagagacagggtctcgctctgttgcgcaggctagagtgcagtggtgtgatcatggctcattgtaccctcaaactcctgggctcaagcgatcttcctgcctcagcctcccgagtagctgggaccacaggtgtgcaccaccatacctgcctaatattttaatttttttgtagggatggaggtctcgttatgttgcccaggctggtctcaaactcctggcatctcggcctcccaaagtgctgcaattacaggcatgagccaccgcatccagccctcagaagtttcttttgcattgaacttgccaagaaaagacccatttatatgatcagccccttgtaaagcgcgtgccctgtcttcagggtagctgaggggctagcttgttttactgtcccctccaaagtttccctgccatggttctaccatagaagaaatcttctcctttatcttccttagttgtggtcagctttcaggcttgccacacttcctcctgggtgagtaaagaggcacatttgggtgccctgggttgggcacagtagatttgaggtaagggagccagagtgctcatttctgcagcagggctctcatcctgcattttagggaagtgtctctggccccctgcaatgcgggatgtttttcttcttttttcctcttgctttatgttagcttgaaccagtccctggtgttttgcttcaggattcttttcttcctccctagggagtaattgcttagaaaatgccctcctgtcaaaaacacaaagtcttcaatgtcataaattggtagtggaaactcctccgtcatctggcttaatatttgaactgttgctaatggctaagagattgcagcatgaaggtgggtccctttggaagcctgttgggtcaactggggtgttggctgtctcctttggtcagtgtgtgtacagtcatttggggaccagcccattcatcgcaggcacttcaatcttttaatgctctcactctttgaagaattataggagccatatgctgcttcccaggtaaccgagacttgctaaaaatagagcttaaatggccccactgttctggcattggaaatcgttgctttttatttttaggccagcttgtgtgatccgtagctactttcaagcttgggcaataagaatcactgagcaagacctttgtcagttgaacactgttaaggtttgaacctccactcccagctagttggaaggagaatccaaatctattgaaatagggagtgctgaccttcacatggctcccctcctccacctccaccctctattaagcaggattctgtttcactgtgggtttagggtacttaccacaagaaaaatacgttgcaaagaatgaattctggctgtgagtttatggcaccagccaaacaaccagaagaacagactggcataaaacagctttgaggccattaaagaacaccaccaaggccgagacccatgcactgtgggttttgggtggtctgaaatggaaattgtcatcaccatacttaggtgcagattaatgcattaaatgataaataagaataggcctaacttccattgctcatttcataagtaatagtctcattttactatccccattcttgcccaccttcagttacagaaataactctgagtgggtttgctttttaaagatctgtgtcaagcagatatctcacaaaaatggcacaggcaaagtgttctatttagaagttgccctgtgacacaaaaccacagtgtgttttcagtccttgggcactggtttctttggacataagtgctaggggcatggtgccggccttccgggggaagtgacttgaaagtgctgtgggctccgcatagagagttttacttcattaacagtcgcttatccgtcaggtccaaaagacgcagcggtggtactggtaaccaggtatattcgtttcctattgttgccctaacaaattaccataaaatgagtggcttaaaacaacacagattttactgtcttacagttctgtggtcagaagtttgatgtgggtctcactgggctaaaatcaaagtgctgactgggctgcattcctttttggaaactctaaggaaaatcccgttcccttccatttcccatcttctagaggcagcccgtattccttggctcatgaccccttcctccatcttcaaagccaccaacagtgacccaggtccttttcaggttgtgtcacttgatcttctctcctgtgcccccgctctctttttaagaacccttgtgggtacattgggtccacctggataatccaggcgactcttccttttgtaaggccagctgatgagcaaccttaattccatctgcaactttcattcccttttgcttgggattgggatgtggaaatctttgcagggggtgggggggtgttgttctgccaatccacaccagggactttgttttcctaaatctccatgtcgggtagggccaaaggggcaatcattttggtggcagcctacgtggaagatggcttctatatttgcagagtttcaggaagttgagagggtttctcttagaccactagactgtgaagtttgtcagataccttgtttctctgtagggtggtcctggagttttgatgatcccagctgagactcttaccaggggctgctagagcctggggatggatggctgtgaaggggagcagggagttaggatgactggtagcagctgggctggccagcgagcgaggaatgaggaagcagggggatgaggacaggaaatgatagacgagtctgccccttgggagagagaaaatagaagatggggttgattacatctggccccaaagaaaataaaagcatgggcttttttgtttgtaggctttgtgattgattctactgttgagtcaacttagacgctgggctaaacaaatttatttgcttactttttggacatccagtgcactcttgccactaaaagcctcaggggttcattgtggccacttggtgtcccgagggaggttggggggtgttgggtgtcactgtccaaacaactctctctggagagagcagcagcccagctggggaccccgtcccaggagggctctgctctggagaatgtaaaccggtctggtacaggctcacagagccttaaatgtgttctcaagaattctaacaaataatctgttgtgaacttaaactggtttggactttgaagaactgacaagttcttttgagaaatagtacgtgggagctttgtgcatcctttcccacggtcccatgactgggaggtatgttacagtgaaagcaagtctcagacacgttttggccactcattcagacacttgttagtaagcaggcatgaagagagccctgctttagctgggcgtggtggcacatacctatagtccctgttacttgggaggctgaggtggaaggattacttgagctcaggagttcaaggctgtagtgagctatgatcctgtcactgtactccagcctgggcaacagagcaagaccctgtctctttaaaaaaaaaagagagcacactgcagtctgttttgtaagctcagcaaagcttgagccctctggccgggccccttttgggaaagagacattcaaggcagatgccactgtattccagtgccgggattcagctaacccccagggaggggacagggtcctcctttagtggttgacaatggcccctgacagtcctgggcctcttctctgaagggggcagactgctgttatttctagattcttttgtgcggttcttctgaggatggagatggtggcacaatattttcacccaattcctagagcagagggccactgcttgttttcatcatgctaattaaccaactctggtgcaaatggactctgattagtctttcaaatgctgatccaccatccctggagtgcttgtttttcatttggatacttcaattgtgagctgacctcttttaggataaggatcaaagccaagtaatacagagctatatgaggagacttcaacaagttcatggaaaatgggtattatgaaaaaactattcatggatttaaatttttttttttttgcaccaaaataaactcacactaacttggctgtaacatgtctgaatagtatctagtttgaggcactaagaaagataagacaccagtttggaaagagcccctatcagagcaacatgaattctgctaaaattgaagcaagaacaaacaccaaacttatagtgaagcttgagtggaagaatggtgaaataactgatgctttacacaaaatttatggggacaatattccaaagaaattagcagtttacaaatagatagctcattttaagaaaggacaaaacaatgttgaagataaggtctgcagcggcagactatccatatcaattttcgaggaaaaaatttatcttgtttatgccctaatagaagaggactgacaattaacaacagaaacaatagccaacaccacagacatctcaattggttcagctcacacaattctgactgaaaaattaaaaccgagcaaattcaatgggtggcaaaaccattgctcccagatcaggtgcaaacaagagcggagcttccagtggaaattctaaacaggtgagatcaagatcatgaagaatttattggaagaactgtaacaggagatgaaacacggctttcccagtgccatcctgaagacaaagcacaatcagagcagtggctaccaagaggcggaagtggtccagtcaaagcaaaagcggtcaagagcaaaggtcagggcaacagtttttggggatgctccaggcatgttgcttgttgacttcttggagggccaaagaacaataaaatctgtttattatgacagtgttttgagaaagtcagagcatgagcagaagaacatccaggaacagttcaccagagagttcttcaccatgacaatgctcctgctcattctcattcctcgtatcaaacaagggcaatcttgtgagaattttgaggggaaatcattaggcatccacttcacagtctgtatttggctctgactccttttttgtcctaatctttaaaaaaaatctgtaaagatcacctattttccttcagttaataatgtgaaaaagactgcattgacatggttaaattcccaagaccctcagttctttagggatgaactaagtggctggtgtcatcacttgcaaaagtgccttaaccttgatggagattatgttgagaaataaaatttataattttatcttttaattctattttccatgaactttttgaagtcctcatatagtacactgtttcttttttagtgtggattgctattttttttattatttatttttatttattttttatttatttttttgagacagagtcttgctctgtcgcccaggctggagtgcagtggcgggatctcggctcactgcaagttctgcctcctgggttcatgccattcttctgcctcagcctcccgagtagctgggactacaggtgcctgccaccacgcctggctaattttttgtattttttagtagagacggggtttcaccgtgttaaccaggatggtctcgatctcctgacctcgtgatctacccgccttggcctctcaaagtgctgggattacaggcgtgagccaccgcgcctggcctgctgtttttatttttaactttttattttgaacaaactttagacttatggaaaagatgcaaaaatggtatagtttccatatatccctttcccagcgtcccataatgttaacatattatataatcatagtactattattagaatcaggaaatcaacattgctatcatactatatatctaaatgctatatgctaaatactatactatgctatactatatctaatactgtactatagatcttgcttaatttcatcagggtttccactaaggtcctttttttgtggttgttctaggttcctcttcagaatccgtgttgcatttagttatttctcctagtctcctgcagtctgtaacagttccccagtctttcttgattttcatgaccttgatgcttttgaagagttattttgttgagtatccctcaaattggattggactggggttatgccttttaaaaatcatggtaaaatatacataacataaaatgtacgattttaaccgttttaagtgtacaattcagtggcatcacgtacattctcaaggttgtgtaaccattatctgtttccagaactttttcatcatcttaaacagaaactctgtacccatgaagcagttacttttcattccccctccccccagtccctggtaatcacacttgtactttctgtctctatgattttgctgttatgggtacctcatataagtagaattatacaatatttatccttttgtgtctggcttctttgacttagcttttgaggctcatccatgttgtagcatgtatcagtacttctttttttttttttttttttttttagaggtgggatctcactgtgttgcctaggctggagtgcagtcactgttcacaggtgggatcatagtgcattacagtcttgaactcctgggctcaagtgatcctcctgccccagcttcccgagttgccggggctacaggtgtgtgccactgtgcctggcctgttcctttttaaggctgggaataatattccatagtatggatagagtacattttgtttagccattcatctcttggacacttgggttgtttctaccttttggctagtgtcatttatgctgccatgaaaatggatgtatgaatacttggttcacattttaaaaggaacttggagaaactggagaagagacagtttggagcaggcagaaaaaggcactattttgtgtttcccatccctgactgaggctttcacagaagcaagggagattgagatgcagtggggcagggagatggcaagtggactcagagacaggtgccagatggttgagaggccaggaggggacagggagcccaacctattatacttgtccaaaggtgctgccactaggggaatgcccagaaggtgcaaacaagcccactggacagggtcaaaggcctaggaaccagtaggagaatgggttaagaccacgatttgctgcagaaagcacagtttgctccacaccacccagagccaggcaggatggtataggcatgggttgggttgaaaattaagtccacttaatatttcttcttgatgtttttcaaatttgggggactatcttccagtaagaaatatatcttaccttgcagccttgtaaacacacctgtctttagttatgattgaaatagtaatttcaggctgggcatggtggctcatgcctgtagtcccagaactttgggaggctgaggcgggtggatcacctgaggtcaggagttcaagaccagtctggccaacatggtgaaaccccgttgctacaaaaatacaaaaattagctgggcatgatggcaggtgcctgtaatcccagctactcaggaggctgaggcaggagaatagcttgaacccaggaggcagaggttgcagtgagccgagattgcaccattgtactccagcctgggcaacagagcaagactctgtctcaaaaaaaaaaaaaatagtaatttcacaacaaacatttgatgtgctctcatattttctatgcagttctgtttcattaaaaaatgcttcttgtgacctgggttcctgggttgccttcatcttgaaaacactgtactacacaaagcctcatatgcgaagttctttctgccagttacttttctttctctatcaagtttttgtccctttccagttggaaaatgtaaaccatgtaattgatcacgtttctctttttgttttggctatgaggcaacacaaaccttggcttgaccaagcgataggtttctatatggcggtcatatactgtacatactgatgccttaacttttcctagctcttgaccttctagctatatttttcctgattctaattggtcatatatttttgttttgttgaattcttgggagctgccacaaatctatatggagtgtgatgatggaatatataacaaatcatggagaacttttgatcttgactgagataaattgttgagtaaagtctgcatctttagagattttgtttttgagacagggctttgctgtgttgcccaggccggagtatagtggcatgatcatggctcactgcagcctcgaactcctgggttcaagccatcctcctgcctcagcctttggagtagttgggactacaggtgtgtaccaccacacctagccaattaaaaacagtttttctttttgtagagatgggatctcactatgttggccaggctggtcttgaactcctgacctcaagtgatcctcctgccttgtcctcccaaagtgctggtattacaggtgtaagccactgcacctggtgagattttattttttttgtgaagcacggtctgggcgatatgattttcttttagctttatgattctccggtttacttttctggcttttgtttcagattacctagaaagcaacctcttcctttttaatttaattttatttattttatttttattttattttttaagatggagtcttgctctgtcaactatcctggagtgtagcggcacaatcttggctcactgcaacctctgcctcctgggttcaagtgattctcctgtctcagtttcctgagtagctgggattacaggcgtgcaccaccacacccagctaatttttgtgtttttagtagagacagggtttcgccatgttggccaggctggtctcgaactcctgacctcaagtgatccacccgcctcggcctcctgaaatggtaggattacaggtgtgagccactgtgcccagcccctttcctttttaaaaaaaggaatttatcatagtggcaaaggtagaattcaaggaagtttggaattagtgtggagggaaggtgtcatttcatctttaattaaggccgtttttacttgtactcacattgcatagaattctgtttacgcaggtgtttttgtttgtttgtttgtttttttaacagaatcttgctctgtcgtccaggctggaatgcagtgacacaatctcagttcactgcaacctccgcctcccaggttcaagcgattctcctgcttcagcctcccgagtatctgggattataggcgcatgccaccatacctggctaatttgtgtatttttaaagagatggggtttcaccatcttggccacgctggtctcaaactcctgacctcaagcgatccacccatcttggcctcccaaagtgctgagattacaggtgtgagccactgggcccagccacaggaatgtctcttaatcaagctccttgcttctattcccctgcctcatctcaagttcccattcccctacttgatttaccatgtttgctgtctaactagtgtgttcctgccacctgcagcctctgcccatgagtccttctgccgcaggtgtcatcagagaacacatatttatagttatacttcctctctgctcccaaacctccagttactccccagacttgcggataatgcagtcttttgagcttgtatcaaggacagagcccatcttgccaattgattagagcaccccagctttcaccctgccctccccgcctccagtccttaggttggaaagctctgagagaggatgaaatggacagaccatctgatgcatatggacctcttgagagatgatttagaccagggaggatgagtttggagttgaatccatttttaagtgaactctccactaagcaaaaaaaaaaaaaaaaaaaaaaaaaaaaaaaaaaagactagtattagctctaggggaaaagaaactagtgataggaaagaaacataatcttagtgtaccatgtggctaggcttttagtaatgtttgtgtagtcataaggatgtaaatacttgtgttagttttgtagggctgccagaacaaagtaccatggattgggcaccttcaacaacagaaatgtgttgtctcacggtccgggaggctggaagtctgtgatcaaggtgttggtggggttggttccttttgagggccatgaggttcctttcgaaggctgtagttgcctctggggaggggaagttggggagaatgaagaatgctttttttccataagagacctttacagctatttgaaactttaactgagtgtgagggtgacttgggtgacctgggtcagcatagcctgtgccgcctgcaccgagctgctcttgccttcattcgaggtgagaaaaggaagtggggatgttatcggccttaaaggtcgctactgacaagaagtgaagtcttgggctttctgaggcccgtttatcatttcattctaaaataacccaatagttactttttagctccttatatgagatctactttaagatactccaaagcagggctttttgggggagggtagtgtagtttattgcatttttgtaattcttcagaagatatctactttcttctctctgttgcagttattgatttagaagcaagctaggagcatatgacagaaactgtcagtaacccactctgaagttaattttgttttggttacaggtaatagtttcatgtctacttctgtggggaacagcagtgatagatttcctctcctttttttttttaaaagctttccttttacctgtgcaaacctctcagtctccccatgctcccatgatgcgatgggggagacactgaacacccaaatgggcatttctatctgcagaaaccctaagttccttctactggtgttaaatagcttgtggaatgtgttagtctgttaagtagccagtggaatgaatgtattaggtcatctgtggaaacaattagaagaaaaaaatctggcaaaggagcagaccaggaaagtttaaaaaaaaaatcctttctggcacgcagttcaattagattagtatgagttgttagaaattaatgtttgcggtgtcagtgagcacacttaaacgacaaaaaagaaactcagttgcagtatgtggcacatcattaaacatatactcagatgtttatttaaaaagtatagatctgtatttcttgtatgtgtagcactgagccaggtagaggctatgtgtagcactgagccaggtagaggctatgtgtagcactgagccaggtagaggctaagagtaaatgaaaatatataatacctggtcctttctcttaaggagcttaaatctgtttggaggtagcaagacatagaatgtaaaagataatgaaagggttaaaataacagtctgagacagggatcagcaaactatagcctacagctaaaatctggccttctgattatttttgtaaataaagctttatggaacacagcctcactcatttatgtttgttgtctgtggctgctttagtgctgtaaaggcagatttgaggtgttagagtggaacattggtcccaccaaagctgaaatacttactatctgactctttaagaaaaagcttaccggcggggcatggtagcttatgcctgtaatcccagcactttgggaggctgaggtgggtggatcacctgaggtcaggagttcgagaccagcctggccaacatggtgaaaccccctctctactaaaaatacaaaaagttagctgggcatggtggtgcgcacctgtaatcccagctactcaggaggccgaggcagaagaatcgctaattgcttgaacccaggaggcagaggttgcagtgagccgacatcgcaccactgcactccagcctgggtgacagagtgacatttcatctgaaaaaaagaaaaagaaaaagcttaccaactccttgtctgggataataattcaaaagatgttacaaagcagtgtatgaggagtaaaagtgatttagtgaacgctatagttagtaagtctgagaatgatggaatgacaggtggcttgaaaaagggttttgaaggtgacctcagaccaagagattggagggcactttgtgatgtaaagagttgggaaggagatttcatggatgggagcatccatggggctcttgggggaagatcgtgtggggagatggggaccaggactatccagctggacttagagccaggtataaatgcaggtgacgttgttaatgtcaaacctgtaccatattgaagcggcctttgagttccaggatcaagactgggaacttcctcaaacccataatatctttcaaaggcaacactcatttacacaatcaatattcattccagacctattatgtggttgactccaaggggatgttaacatacatgtaggcacatcgctctcgtagactggtgagtccagcttgtttgactcagtgctagttctaggtatgtttaaagaaatagctgccggctgggcgtggtggctcacaccagtaatcccagcactttgggaggtgaggcgggcagattgctggaggtcaggagtttgagactagattggccaacatggtgaaactccgtctctactaaaaatactaaaaattaaccgggcgtgatggcacatgcctgtagtcccagctactcaggaggctgaggcaggagaattgcttgaacccaggaggcagaggttgcagtgagccgagatcataccactgcactccagcctgggcaatagagcaagactccatctcaaaaaaagaaagaaagaaaaattgtcatttagaagagaggtttaacctcaagaccctccaaaggctgctaataccaggagacttgtatggacaggtagtctcccattctgtgaggacagtgttctagagagagtctttgagaagggacttctggctgttgtttttttttttagatggagtttcgttctctcttgcccaggctggagtgcagtggtgcgatcttggctcactgcaacgtctgcctcccggattcaagcgattcttctgcctcagcctcccaagtagctgggactacaggcgcccaccaccacgcccggctaattttgtatttttagtaaagatgggatttcactatgttggccaggctggtctcgaactcctgacctcaggtgagctgcccgccttggcctcccaaagtgctgggattacaggcgtgagccactgcatctgggcgagaagggacttctgaaaaggaatgttgtgtaggtgagagatgtgccagggggaagggaggaggagaacccccacccatccttagacactgtattgtccttccttccttttagggcttctgtgctgtctaccattttttttctgggtctgcaaagctccctgcacatatcctcgcagggtgtgcttccaccctttaggtacccagccctatgcagttggtgagacatcataatgtttccacatgccaccatctcccctactccctgaccaccccctccaagcctgtatcctgctgtcttggcatctgttaggcactgagcttccccactttccctagatcagtcctgccacaggccactgagctcacctcaaaatcctttctctcctacctggacacagccctggggcacctgggccctgcttgtctctggccctgcagtggtcctcattgtcacccattaatgcttccatttacttctctctcactcttttttcttttgtaaattaaaacacacacacacacgtgcacacgcacatacacacacatacacagagacagagataaaagaaaattctgtagtgcattttgcagtgagtttattccagactttctctcctcaagctcctcaaattctcttctcacctgaccctaaccaagagatgaccttgattcctgtttaagagaaggcgtcaactcgcttgtgtactctcatcttcatggctttatatcactgttgtaatgttgatccacttttatccaatgccagagaaagatacccttccttcttttttttattgttctctgacttctctccgatcatgcattcctgactcatctgcctgttgtccagcatggtgaccctgtccccgcagaccgtcagtaagtacttactggatcaaagagccattctgtctgagaaaatgtcagctaagaatgtagaagggcagcaggcctaatttggcctggtttcatatttgaacctactgcctatattcatgtgtgcaattgggtatgttcgtggatttttttttttttttttttttctgtgcagctacagtatctggaacatatgtctcagaaaatctttattgattgaaaaaaatatgagcaggaacaggggcaagaagacggactttgagtccagactggctggcggctggaatattatctgatctctctgggagttggattctttcctaaaccaggaacaataataggcaccttgtagagcgtattccagttcctgttgctgtgtgacaaattactccaaaatttagcaccttcaaaaagccattttatgcttaccagttttgtgggtcaagcatttgtacagggcgtggtagggagggcttgtttcagctctacagtgtctggggcctcggctggaaaggcctgaggtttggagtggacatgacagctgggggctggaacgatctgaaggctgggtccctcacatgttgggccaggctgggatgactcagtaactaggcatgccagctggtgtgtctcagtgcaaattggcttccttacagcatggctgtcttggggtattccagcaagtgagttggaaactgcataatatggcctagaagtcacacagcatcactttcctccactctgttggtcaaagtggtcaccagcctgcccaggttccaaagcccggggaggaagattagatttctcctgttgacagctggatcacattctagaagagctcaagggacaggagatgttgctgtagccatcttggaaaacacaattggccacagagtgatcgttacagttaaatgatacagtgaggaggataaaggcacctgacacaagattttaagagtatattttctgccgggcatggtggctcatgcctgtaatcccagctactcagggcgtcgaggcaggaggatcagtagaggccaggagctctagatcagcctgggcaacatagtgagaccccttctctacaaaaaataaaataattatctgggcatggtggcaggtgccagtagtcccagctactcaggaggctgaggtgggaggatctcttgaggccaggaggttgaggctgtagtgagccatgatcgtgccactgcactccatcctcggtgacagagtgagaccctgtctcaaaagagtatattttcatttggtaaacatttatgaagttcctactatatatcaggccggtcctgggtctacagaggcaaacaaagcagacatgctgtctgtcctcctgtagctttcagtctagtggcggacacaggcagtaatcacatgtaattagatctggaaattcctcctccttttctggacaggggctggtgaaacatctggattcgtgtgttgcattttaagtgtttttcttttttttccccagtgaatgatgaggaaggggatctgcccattgttaatgtggaacctcttgctgctgtttgttttgttttgatacttctacagatctggaggctcatagcactgaaaggtgccttgtcaggcttgaggtctgcaagcaccccctgacccttttgttcagcttcagacttatgtttctctttctgcaaaagggatttaggagagtagtaggggtacatagagtcacctgggagatcatcttcagcctagacatgacccaccctgccccccgccccattctgatgggaaccagggtgtggaggagacaggcatgagaaagtttcacaggggattctaacatctctgggtgaggaacccagtgtgagatgggccagcgcttcccaaaccatcccatgcatgtgagtgtcctggggatcttatgatgcagcctcagattcagtaggtctcggggaggctgggggatgcctctgagtagtgagggtatgtggagtaccaggcgggtacagatagagatgcctgtggaagtttgctgcaccctgacgaaagggccagttctcagagagttagggtgctgagggctagccaggtgagctaccagatttctgtcatgtttcagcacgcaattcttacagataattactctgctaaaaaccataatcacaatatcacttttacacctaaacaacgcaaacaacagccttccttatgtaaaacacatctcaagaaactcaaattcagaatgttggcagaggtggccttgtccacactcatagatctggtgtagaacacacttttgattgtgctacttactcatttttaagtagcttatatgtattttttaagtagcttatatatcccagcactttgggaggtcgaggcgggcagatcacttgagttcaggagttcgggaccagcctggccaacatggtaaaaccccgtctctactaaaaatacaaaaattagccaggcatggtggcgcgtgcctgtaatcctagctatgcagtaggctgagacatgagaatcacttgaacccaggggcagaggttgcagtgagctgagatcgcacctctgcactccagcctgggagacagagcaagactctgtctctaaaagaaaaaaaaattatagatgcccagtaccctttataacaaattcaaatattgaaacatacatatgtatacaatacacacatttaatattttgttgcctttaaaacccccatcttcctttccaggtgcattgctatgcccagcatggtcagctgaatcatttgtgaaatagtgattacaccagctagagttacgccagcataaagatttgcatgttttcagttcagtgtaggacattattcttctacttgcacatgtagagcattttaacaatccggaagtgtttcagcatatattttgtaaagataaggactcttttcaaaaccataatcacaatcatttttacacatacagcaactaacagtgtttccttatcatcagacatttaagttcaaatatccaatttttacatgtagtttaaatattttaaaaggtgtttgtttgaatcacgatttggaaggtctgtactttctaactggttggttgtctctgagtctgtttttttttttttttttttcactctgctacccaggctggagtgcagtggcagtctcagctcactgcaactgctgcaacttccactttctgggttcaagtgactctcctgcctcagccgcctaagtagctgggattacaggcacgtgccaccacgcctagctaatttttgtattttttgcggagacggggttttaccatgttggccaggctggtcttgaactcctgacctcaagtgatccgtccacctcagcctcccgaagtgctgggattacaggtgtgagctaccgcacctggcctctgagtctgttgtaatctaggttctgccatctctttttccttgcttttgttgttgttgaagaaactaagtcatttgcctacagtcctacagcctggattttgcagattgcctccttagagtgccatttaacatattttcggacgttctgtatcccctgtaaactggtggtaaatccagaggcttgatctgattcaggttccgtttgttggcaagaatattttgccagcggtgacacacacttccatcatgaggctccagatgcctggttgtctctctttttgtaatgtccacagctggccaggcacggtggctcatgcctgtaatcccaccagtttgggacactgatgccagaggatcatttgagcccaagagttcgagaccagcctgagcaacatagtgagactctcatctctgaacaaaaactttaaaaaataagccatgaaatttaaaagaaattaaaaaaaaaagctggatacagtggctcgcacctgtaatcccatctatttgagaggatgaggcaggaggatcatttgagcccaggagttccaggctctagtgagccatgacaatggcactgcactccagcccaggtgacagagtgagaccctgtctcaatcaatcaatcaatcaatcaatatccacagctgctagtgaccattgctcaggttcttgattgcattagaggttgcaaaacgttgattgtccaattctctcattccttcttcattttattagccagaatattcctatacagagaaatttctcatcaaccatttggttatcttgaattcatataggaaaggcaggacaaatgtttgattctttttttaaatttaccagtttcaaaacaatgagttggctccctagcatcttccaaaggtggccaatgatgttttaaaagtatcactgtgaaagatatatcacataacatatgagacatcaaattaatttgatgtctttcaatccagttattgttactaatgcagttattatttcagtgcactttcaatgctgtttcaaggcagttattgttaatcatgctcatgttgccccatttgtggccagtgggagcctcttcaggttcacttctgagttgttttgacatgaccctagtagtgtttgctggcctccttgctttcttggtgtgacaagatggcccaggcttatcacctttcctgccccagaaatgaaatcagccatttatctaagggtagctggctttctttttgtgaaaaacggtatttggagactgaatgtgattatttcagaaaaaaatgtatacattgctcttcatagatcattattcttaggagtcttttggtgtgaggctgttgatctttttaattttatttacttattttcactaactcatatttcaattttgggaaaggtttcaaaaattttaaacccaatccagtttatttaggttttattctctttttcgaactttaagctataaccttcaaaggaaagcaaatgttgggttttaacttcacttcttttttgtgttactctatatagacacatacttactcagtggcttcctgatgctgcaataaagtatttacaatgtagttgattaagaaaacatttgtgaagtagatacttgactagcaactttttagttcaaattattgttcaatattaaaaagtaccaactcaaatgacttacaaacgttggtagttactgtcttgatagactcccaattactatgtgacatcattggtgaaacttaggatgaaaccgtgaaatgcaccctccctaataacctgcacattatggtgttgcagatatgctagatggtatctccagattagatgtctgggagcctaaagtagttatacttatgacagtttgaaattctagactgctttgaagagctgttattttgctgttatcttctgcttttatccctgtacatttgtctcagatctcatctcagattctcagcttcttgtcaaaatcatccttgcaagtttcttgcccctcgacaacaagcatttcttgagtgcctgacggggccaagcactcagccaagcacttgagggaggaagatgcattgggcaatatgacttttctttcaggaggcccatcagcttctgttttacatgtcccttttgccttctaggggctcgcggtagcaggattactacacctgggagtataaatgaagcctgagatgggacattaaatctgccggggagaaagcagtgaggattcactgtggtttcctctcacgttacctcactgtctgctatctctcttatgagaaagtatgtttcttaacagaaggccatgcagtgagtgactcagcccttgcccacccccaaccatgctgaccaaccacatttttctgtggaatcgttcttccctccttttgacttggtccctgcctcttacagctgattcagcttagccacactgaaatcaacaggaaggcttttgcttttcttctttcatacaacatgtccaaatataaagccaacctgcccccttactatcctatcctcaagacaagcaagagttgctttccatgatagtccttacaaagtatcctgtaccataaaggctctatgaatttattttgaataaaatagttggagcaaatccttcagataccttatccataataaaattgtttcatgaaatgagagggtgttggggggtggggagcgatgttttctaattattttatttcacataatctgtaattacattaatacatagtataagcagacacttgactgtttcttcttctgttttgaggtttacatattcaggttagcccacaaccttttggatcttctcactgagaaaaacaggggatctctttctaatcaggcacttgtctttgggtcttttttgaatctgagaactaggctatcattataaagtcaggaaaatctctactcatcctcaagccattttattatgtaacactgtcaaatatttatataaagcagcatactttcttctccatgcacaaaaaaaggttatgtctttaagtggctaaacttttttgactaaacagactttttattaaattggttttctggccagatgtggtggctcatgcccgtaatcccagcactttgggaagctgaggctggccaatcacttgaggttaggagtttgagaccagcctggccaacatgatgaaaccccatctctacttaaaaaaaaatttagctgggtgtggtggtgcatgcctgtactctggaggccaaggcaggagaattgtttgaacccaggaggtggaggttgcagggagcctagatcgtgccactgcactccagcctgggcgacagagcaagacactgactcaaaacaagaaaagaatattgcttcataaacagttgtgcctagtagctcaggagactacaattaagtccatttaaaaaatgtgtttttctgagattccatgtaacactacctgaaaaaaagtagaatgatgggaattaattggaggctctaaaaactaaataagaatatcgggccaggcatggtgactcacccctgtaattccagcactttaggaggctgaagtgggtggattacttgatgccaggagttctagaccagcctggccaacatggcgaaaccccgttctactaaaaatacaaaaattagctgggcatggtggcacatgcctgtaatcccagctactcaggaggccaaggtaggagaatcacttgaacttgggaggcggaggttgcagtgagctgagatggcaccgctgcactccagcctgggcaacagagcaagactccatctcaagaaaaaaaaaatggttttctaagattccactgatttttcccctccgtgattgttgtatagaaccattctctacacaggcttatccagctttaacctgttgtctttattttttactaggttttgttgttgttgtctgcctgtttgtttttgagatggagtcttgctgtgtcgcccaggctggagtgcagtggcatgatctcggctcactgcaagctctgcctcctgggttcacgccattctcctgcctcagcctcccgagtagcggggactacaggtgcccaccaccacgcccggctatttttttgtatttttagtagagacagggattcaccgtgttagccaggatggtctcaatctcctgacctcgtgatctgcccacctcggcctcccaaggtgctgggattacaggcttgagccaccgtgcccggcctgttttttaacctgcaaagtcacctgcccactttctccattctttctttttcacttaaaaagccttcttctggtcaagttatttttatccagtctatctaatggatattctattttttgagacggagtctcactctgttgcccaggctggagtgcagtggtgccgtcttggctcactgcaacctctgcctcccgggttgaagcaattctctgccttagcctcccgagtagctgggattacaggctcccgccaccacgcccggctaatttttttgtatttttagtagagacggcgtttcaccatcttggccaggctggtcttgaactgctgaccttgtgatctgcccatcttggcctcccaaagtgctgggattacaggcatgagccactgcgcccggcctctaatgcatattcttaaaagagctgtgtgttaggtttgcaggggttaatttcaggaagcgtttgataaccctttgtttttgctccttgaggttttgttccagggacagcccctggtgaggcagaggcttcagaaggcaagtggtaggggactcaaggcccacaggtcttgtgaatgctttcccatccaggccctgcatttcattctgatctttgattgaatgcccctctgctatataggcattggttgtggtgaaggtaagagtgaaatcaagactgatcacagtaacttgagaggcctggactagtggcgtatacttgttttgtggccaactggtcatgttgatcatcagctttctctagccttcaagttaaataacaaggctcacatttgtaactgcatttctttgagttgaatggtaaggtatagttcgaggtcagtactttgtaaggacactcctggtgtcgtatggtgcactcagtcaccaacatttattgagcacctactttgtgccagacaccagacgaggaggagagggtgctcagatctgccctttaagagctcccattccagggtgtgtgtagggagggcatgtcggggaagccctcacagcatagcatgataatgacctgcaagactagcatctggcattaatggagcagcttctgtatacagtttacagatatcacgtctcacccttgccacagatcaccttctgattttaaacacaaagaaagtgggctcgagctaggaatctcaccccatgtcacacagccagtgaatgtctaagctggaatttgctcccaggcctgctgggctttctcctacacctcatgcttagaggtgacaagagaggagagatgggctgggaggctcaggttccttgggccttcgtggaaagcagcaagtgacaagagtatccttaatggtgtctgaggcaggcaatggtgggcctttctttcctctcacacagccgggtttgttttttctcttctttcttgattcatctcttttctgctttccctgctgctccccaattctttgagctgctactgggcctgctacagacattgttgaatcctgccagaggccatccagccacaggtgtgctgcctcctgcccagggagagagttcaggcccagggactgtctgtcactggggtccgtgttctgagcctgtctttgttggggaagctgatgttcagtttttaagatgcaggtcttgggaattacctgcttgttgggttgatgtcccttagtggtgtgtttgtgaagacaccaaaaggaaaacgtggctggtatgtaggtcagctttattgtacgcggagatccccacagtatctgtggccttgacctgggaaattcagacccccaaacccttcagccctgacactaatgggagggcactggatggtaagaacttggccttgtgcagacttgcatagagaagagtctgtgtgtatgtaaagttgatgtatggccaggcatggtggctcacgcttgcaatcccagcactttgggaggccgaggtgggtagatcacctgaggtcaggagttcgagaccagcctgaccaacatggtgaaaccccttctctactaaaaaatacaaaaattagctgggcgttgtggcaggtgcctgtaatcccagctactcgggaggctgaggcaagagaattgcttgaacctgggaggtggaggttgcagtgagccgagatcacgccattgcactccagcccaggggacaagagcaagactccgtctcaaaaaaaaaaaaaaaaaaaaaaaaaaagttgatgcacgagtatctgttacggttctctggttttaagtaaaagaaaccaactcttccttaactaaggtagcaaaaaggatttatcagaaggcattggggtagtttatagggtggaaggagaagctagaggatcaggtctgagaaagatggcaactgggcagcttcagggatctcacttctgagagccctggtgggggaatctgctccagccgtctccagtgtttgtcacattgctttgatcacagttgggtcctatgtcatacattggctggcagagggcagggcatgttgatggacagtcccatcaaactatctcatggtggaggggaagttcccccaaacagttcccctccctgcatggggagtgttctcctgctagggcacaaacacagtctaccacctcaatgaccgacaatctacaataataaattcttaaatatatattgtttagacttttaattttaatattattatttttttgagatggattcttgctctgtcacccaggctggagtgcagtggcatgatctcagctcactgcaacctctgcctctggggttcaagctattctcctgcctcagcctcctgagtagctgggattacaggcacgtgccaccacacccagctaatttttgtatttttagtagagacagggtttcaccatgttggtcagactggtcttgaactcctgaccttgtgatctgcccgcctcggcctcccaaagtgttgggattacaggcgtgagccactgcgcccggccaatttttatttgtaaaagctgtactgaggtataaaatttcacccattttaagtgtacagtttaatacttttcaagtaaatttacagcatcctgtaactctcaccacaatttaatttgagaatatttccgtcaccccaaaaagattcttcatacccatctgcagtccatccccattcccatccccggccctaggcagccactgattggttttctgtctttttagatttgaacatagtttttttttaaatatgttcctgactggtgtaactttttctgggtattctggaaactatgttatacatgaaagaaaaaaagagcccccccccacccccccgcccgcatcaatggtgtgaaagtctgtatctcgctggtctcaggtttctctgctttctcttttaaatccttccttctctccagtggaccataatttaggagaacgtagccctgggcttgatgctgccattatttacctctcaatgtctctaagcctaagtcatggaaccttctaggcctcagttcctcatttgtaaaattcaggaaaaaaaaatagactagatgatatctgatgttctttccatctctaatgatcagtactcatgatcttttttggtgaagtctgttttggcaaaaaattacttcttgattttctatgcccttcagaggactgaaacaaaacactaaaattaaaaatttattcttcagaattcacagaacacaataagtgcaaaagcagtaagtgtgtaacatttctacttctgaaatgattaaagcttactgcactgagacctctgtgacattgtgtatatgtgtatacagcggaggaaattaattggaaactttcattctccttcatgctttctggtttattcaaatatttattgaagcagacaggatgctaggtgaaggatttagaatcctggcaaagataagggcttttcccagatgaaggttgcagtctagttggggtaagtcagtgtgaaattatagtgaggtgaactggtcctaggagacaggaaggacagtgagcagagggaggtagggaaggactgggtcacagagcagggccacggatataccaccgccaccaccaccgccatagtgagaagctggccctgagaagctgctaggcagctggcttagccaacccacagttaaaaaccacccatttcgtctttgggggaggagacattccagcaagtttgaaggtagagataggggagggtgaagtgttttgcatttctaagcagatctcttatctcccctggctctatctttttgtaacatggggttaactgtagcattggtttttgcagtgactgtagatgtagcaaacttgtggaggctggccttttggcacagcacacagctggagggtggtatttttctgacagggagatgttcttaagttttgtaatttatggtgtctttaaatatgggattttgtttactgttatcctaattacacctctgatgtattttatttagcttaatgttttaattttctgctcatacccagaggtaatttctcaaagggtaccactttaaaaaaatcataggtaatgtttcatccttcctgcagttacctgcagcctctcgaaggcaaggaaatgggttttgggggcatagactttcttctgggctcttgtgatataattttggctgtgtttgtatcatccaagatcttcaccacctgtttgccaagtattatcctaaaccattctgttctatagagacgtgatacaagccacatgtcattttaaatgttctagtagtcacattaataaaattttaaaaaggtaaaattaatttgtataatatatttatttaacccaacagatctaaaacatcacttcaacatgcaattgatgtgaaaataatgagctatttcacattatttttttctaaacaagtctttggaacttgggatgtatcttatggcacacgtcagttcagactagccacattccaagtagtcattagccacatttgcagtgacactgtattggacatcaaagttctaaacctttcaaaggcttgcagagggcactggaaagagcccttagagtgggtaggagagacatatcctcatgatttatgagctcttaacaaagccacaggtttcctcttcttagagaaacctgatatgtaaaaaaaattcatcttgacaggaaaggtaaagcaggaagtaattattcatgttacaaaagaattaaccacaggatcttttaaatagcaagctcccttagtgcacggaagaatatgactcaatttgcaaaatgtgattgacacttgacattttagtagcacctttgttgggctgggaacggtctatcatcataaaatgcaagctgagtggtcagttgatcaagtctttattgagcacctactgcatgtcatggatgcttataggggccccagcagaactaagggtgatccatacccagaaggcattcaggggctcacagggaagacaagacacagcttgggattgcctcagtggcaggggccagagaggccttgggtctagaagagcttggaaggtgatgtggaggcagtcaggacctagctgtggccagaaggcaaggaggctgtgcatgattacttaagtttaaagaaagggcaatggccagggtggtcgctcacgcctgtaatcccagcactttgggaggccaaggcaggcagaacatttgaagtcagcctgaccaacacggtgaaatcctgtctctacaaacaatacaaaaattagctgggcatggtggtgtgcacctgtagtcccagctacttgggaggctgaggtgggaggaacacttgagcctgggagacagaggttgcagtgagctgagatggtgccactgcactccagcctgggcaacagagccagaccctgtctaaaaaaaaaaaaaaaattttgttttttttttttagtatcttcttaattatgtatagattgtgtacatatattcctgtactaattgaagatcaagaaaaccccagagaagctcctacgctgttattattaggcttaacaaacttttgaaacacataaaattgagtattgtatgactttagacattggtggaaaaatgaagacattttcttcatggttcaggtacatagttttaaaatatcttgctaatcctgatggttccacacttacaccaatgtcaggggtggaaagaaacccatattatgaatgatcttgataactgagtgtttgggggccatctccccgtaagatctgatgtgtcttccccatgtggtgggcaaagagctcccagcagaagctgaagtggcaactctatcattttctttctttctttttttccttttctttttttcttttttttttttttttttttgagacaaagtttcgctcttttccccaggctggagtacagcggcatgatcttggctcaccgcaacctccgccttccggtttcaagcgattctcctgcctcagcctccagagtagctgggattacaagcacccaccaccaagcccagctaatttttgtatttttagtagagacagggcttcatcatgttggctaggtaggtctcaaactcctgaccttgtgatccgccggccttggcctcccaaagtgctgggattacaggcatgagccaccgtgcccggccagctctcccattttcttggcacttggcctcgtgttgtctacagctcctactttctttacacagatcttttcaagcagctgacccactttgtgagggtgatttcagcaagaaggggtcatagccataaggaggctgtaccaggaggcaccagagaactgcagggcaccccatggtggggacacagtcaaaccatatcagatgggaattattagctttgacatacaactgagacctagagaagttagcatcacatggaatgctggtgcttgctctggtggtactccttgattccactgtccctctggctgcttcctgccccttaaaggatccctgactgtgtgtcctggagactgggtgaaggaacctgtgtcattctgtcaatggaacaatagagaagttgaattattacttttttaaagttaaaacaaaatgaatagacattgtaatttttttctcccatcatctcaatggatgcttaaaacctatctcagtgtattgaagttggtttgttgttgttgttgttgttgttgttgttgttgttgttgttttactcatttgtgctttttgtctcctatttaagaaatctttgccaaacctaaggtcattaagattttctcctatccattcttataaaaagttttacaattttagctcttacacttaggtctgtgaactattttgagttaattttagcatatgcatgctttacagagctcatttaacttttcctcttccattattttatcataatttctgaattgctaatttaccactggggatttatctaatttttgctatccttgtattcattcatttgccattcattcattcattcatacggatctgcaaataaaaaaggaaaaggtggctgggcacggtggctcatgcctgtaattccagcactttgggaagccgaggcgggcagatcatctgaggtcaggagttcaagaccagcctggccaacatggtgaaaccccgtctctactaaaaatacaaaaattagctgggtggggtggcatgcattcaaggagaatcgcttgaacgtgggaggtggaggttgcagtaagctgagattgcgccactgcagtccagcctgggtgacagagtgagactccatctcaaaaaaaaaaaaaaaaaaaaaaaagtgttatgaaattggttcatattgaggtggtcatgaggagaagtccagtctaaatgaattgcataagttaactaatttttggattggttaatgctgctaatttgcattggcactttgtcagtgagaagacccacctttcttacctgttgcctttgctcattaccaagtatgagagattttcatagatcaggaaaacaatgtaacatggaattgatgcgtaagagctcatctgttgagagggcagttgtggttctgatgtaggcggtctgagacattggcttggccagccaggccctctatgccacctgtctttacacgtgttgttgctgcaagatgggtgttacctctgtcggatggtgtattagtctgttcttgtgctgctaataaagacatacccaagattgggtaatttataaaggaaagaggtttaattgactcagttcagtatggctggggaggcctcaggaaacttaacaatcatgacagaagggaaagcaaacacatccttcttcacatggtggcaggaaggagaaatgccaaacaaaagggggaaaagtcccttataaaaccatcagatctcatgagaactcactcactatcacaagaaaagcatgagagtaactgccctcatagttcaattacctcccactgggtccctcctacaacacttggggattatgggaactacaattcaaggtgagatttgggtggggacacagccaaaccatatcagatggggattattagctttgacattttgtacaactgagacccagagaggttagcatcacatagtattggcgggggatgggagacccagaagtcaaaccgacatctgttgtctgtactctgagctcggggagacaatgctggacaccctctgggtggggcaaatgttgttatctggctgtcatcatgcagcttcccctctgaagcgcctgctggccccaagacctgtaggccaccctgcctgtgcctgaccacggaccagcactttgtggtttctgtgctataggcttcaggttaaccaaaattgggttactgtgtgtggccctgttattttgaatatttgtagaggggaagtccctttaatgttactttactggccttcaagggatactggacctcagccttctccaacatctgacctaaattactctgttttccctgttccttccagtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagtgagtacaaagcaaaacccttttcctgtctcctgtgtgggctctgctgaccaaagtctatgggggcgcttgaggatgaattgcatgaactctcttagggaatggcttgccctcctctgtgatatcaagagaagcatgtatagttttgcccttggtatctgggatacttgttttgaaattgcttttttgaggctcaggatgatctctttccactgtgtatcacttcttaggatatgctaaggctgggtgcagtggctcatgcctgtaaatcccagcattctgggagactgaggtgggcggatcacttgaggtcggaagtttgagaccagcctggccaatatggtgaaaccccatctctactaaaaaaaaaatacaaaaattagccaggtgtggtggcatgtgcctgtagtcccagctactcgggaggctgaggcaggagaatcgtttgaacttgggaggcagaggttgcagtgagctgagattgcgccactgcactccagcctgggcaagagagcgagactgtctcaaaaaaaaaaaaaaaatagtaaaggctgttaaattgttgtatgtacttgtttatttgctttggaagtttaaaagaattttatttttttctattccttgcaaaatggaggtaaaactcagttttgaccacttaaataacaattaaattaaatgtagaattcagccagacatggtggctcatgcctataatcccagcactttgggaggttgaggcaggagagtcacttgagcccaggagtttgagaccagcctgggcaatatagggagatccctgtctctacaaaaataaaataaaataattagccaggcatggtggtgtgcacctgtattctcagctacttgggaggctgtggtgggaagatcacttgagcccaggaggttgagactgcaatgagccgtgatcatgccagagcactccctgtctctaaataaataaacaaacaaataagtaaaggtagaatccaaattatggaatgctttgaacgaatgaatgaatatagaattcaaattatgcaatgttttccacctttgtattcatattgcctttttttttttttttttgagacagtcttgctctgttgcccaggttggagtgcagtggcatgatcttgttctcagctcactgcaacctccacctcccaggttcaaatgattctcatgcctcagcctcccgagtagctgggattacaggcatgtgccaccacgcccgactaatttttgtatttttttttaagtagagatggggtttcaccatattggccaggctggtctcaaactcctgacctcaagtgatccgcccacctcagcctcccaaagtgctgggattacaggtgtgagccaccatgcccagctcatattgcctttttgataggagcaatattattttcctttacccctttatgtccatgaagcattaaacaagacttacttcttcagtaatgttttgaaaattatgccttttggagaagtcatctacaggttaattataaaaatgtaactcattcatattaataaattaccacacagttgtaagtagtactttgaattgttgggtagaaaaagatcacctggaggctattcctcatgggaaatattaactaggtctagaagtccccttgccataaactttctatctcatactggagaagaatggattgttctcagaagaatgggttgtcctcagtgggaagacctgcatgcagaagtccccaggtcccctgctgtagtctccgtgttaccagataatacttaagaggactgtgccttggatacagggaggcaggtagtatggggaaccttgggcccagagaagcaggtgacccccgccaaaggagccctgagggctgggtgggaggggttttttatgacaaggagttgttgatgaaaaatgtgtgatggacactggacttccagtcactaccctttcagagtcgaaaatgaataggaacctatttaaatctttctttaggatcttgtctcagggtgatcctgctagcatttctgttttcttttctctttggtgtgagaaggctggggagagttttgtagggaacatgctgctaaacattgctttctggagttgtaggaatataggctttccccccactgtactacacttgaatccagccgctcgctcccattttaagagtgggaaagtgctgcatctgggccaccacagactctgttgaggtgtgaatgggagttcttttgcatatcccaacaaagaccccagttttaggaaaggagcatccctgaagttgagctgcattctagtgtggaaagagggtttttccagataaaaggggcagtggttagagtgaagatgaaggaagaaggaatgacagaaggggactgtgggaaagagagaagaccctgggaaggagggaagactgtggggaaggatagcaagattgtgggaaagtgagcaggactgtggggaagagagaggagggccctgggaaggaaggaggactgtggaaaggcgaggtggatggtgggaaagagggaggaggaccctaggaaggaggactgtgggaaggggagaaggatcatgggaaagagagaggaggaccctgggaaggaaggagtactttgggaaggtgaggaggactgtgggaaagagggaggaggaccctgggaaggaaggaggactgtgggaaggggcggaagactgtgggaaagacagaggaggaccctgggaaggaaggaggactgtgggaaggggagaaagaccatgggaaagaggtagggggaccctgggaaggaaggaagaatgtgggaaggcaaggaggactgtgggaaggggagaaagaccatgggaaagaggtagggggaccctgggaaggaaggaagaatgtgggaaggcaagaaggactgtgggaaagagggaggagggccctgggaaggagggaggactgtgggaaggagaggaggaccgtgggaaggagaggaggaccatgggaaagagagaggaggagcctgggaaggagaagggactgcagcatcagctccagttttgagggtaggtcgtattttgaacacctttaatgtgtcttgttggcctagtgtcacctgattttaaaccacaaatctacagattcagagaactgagttggaaggcactgagaaagcctatggaatttgctcatagcatagggctggcgcgctgtcagtgactgtggagggaaccagggcagggaaatgcagtgtaggaactgcccacgcgagagctggaacctgaccctccccctgctcggagaggactccttgctgtgaaatggaggtgatgtcttgaccagaaggtctccgcattgccccacctgctctgctttgggctaggccagtgtgggcatggcagcaggctcctgtcctgtggcttcccatgggctttggctcaagggaagccctggtgggagatggcagggagggatgcgagtgagattggggggcggggggaggcggttatcccaccaactccctgctcatgtggattttgggctggccgtgtctctcatgggatgggtggctgctccagtcaggctcaccttcctccttacccctctctcctcattccttcaggtctgggggcttccttgtttcgagtccctggctaccaccttgggctttctttatacctcacccaccctgtgaaagagtattaatcccacttgagattaccctaattcgagtgggccatctgtttccttttgagaacccgactacctcatcggcctgttcagaggattaaaccagagaatgctggaaattgtttagcacagtggccagcccctcagtgagtgtgccacagtgctggtcactgggtgagggaatgggtcctctcctctgggcctgaattgccctgcgctcacctgctcaggtgtcctctagtttcagccggagcacttccagggaggggaagacatgctcttgagagatgcttgctctacctagggcagaaaggatgtagcaggagtggctggggctgcgctacttgtagctgtcacatttggcagaaaaagaaacttctattctttcagatggctgagtctattttcaagtcttcacccactggaaatgttttaggcctattattgaaaattcagtaggtggttgcagtggagttaaacaataaccaggactctgtagagaattctaaaagctgaaaatgcatctttaagtaatagtaatcatattggcataggtgtgcacttttgaaagtggctttatgcatgtcctatgtagtgtaagaataatgtgtccccagatggaattgggtagttttgtggaatgtctttctttttttttttttgggatggagttttacccttgttgttgaggctggagtgcaatggtgtgatctcggctcaccgcaacctccacctcctgggttcaagtgattttcctgcctcagcctcccgagtagctgtgattacaggcatgtgccaccacgcctggctgattttgtatttttagtagagacggggtttctccatgttggtcaggctggtctcgaactccctacctcaggtgatccgtctgcctcggcctcccaaagtgctgggattacaggtgtgagccaccacacccggtcaggaatcccatttttatacccacatgcctttctgtccatgttaccactgtcagagagcctaccttaagcattttcttttctttttttttttttttttgagatgggttgcactctgttgcccaggctggagtgcagtggcatgttcacagcttactgtagtgtcgatctaggctcaagtgatcctcccacctcagcctcctgactagctgggactataggtgcacaccaccacacatggctaatttttgtatttttagtggagatggggttttgctatattgcccaggctggtcttgaacttctggcctcaagtgatcctcccgcctcggcctcccagaatactgggattacaggcgtgagccaccatgccctgccaaacattttcttgattcatttagcagatccttattcagtatcccatttgagcgtggtcctccagagtgttgggattcgtatccaccttcatctcagtgctgtctcagtctctcaagagaaaaataccagccattcccctggtatactgagtagcaggccatcccattgttaagaagatacctgtgctttgtcagctcttgggctatttttcattatgcagaaatgtacccagctaggccacatgcctttttaggtttgtctctcttttatttagtttgtccttatttatttattgtaaatatggaagaagaatcttttaaaatctcccttctctttcttttctttctctctctccccacccatgtctttttttgagacagggtctcattctgtcacgtaggctggagtgcagtggcgtgatcacggcttactgtagcctcaaactcctgggctcaagcaattctcccacctcagcctcctgagtagttgagaccacaggtgtgagccaccacacctggctaattaaaaaaaaaaaaattatgtagagacagggtctcactatgttgcctaggctggtcttgaactcctgggctcaagcagtcctctcactttggcctcctaaagtgttgggattataggcatgagccactatgcctggcccccacccacttattttggaatacatttttctttatccctcccctttacaaaagtattcatttttaaggtgaaatttatgtagagtaaaatgcataagtcatatgtctatggcttgatgatttttttttttttgtttctacgtaagtgcgtacctctataaccaccacccagatcaatgctatttctatccctctagaaagttccagcatgcctataaaaaggaagggggaaatgtcagagtcgttggaaccagagcaactgcatcttgaataggggttaggtaaaataaggctgagacctactgggctgcattcctagacagttaggcattctaagtcacaggacgagataggaggtcagcacgagatacagatcataaagaccttgctgataaaacaggttgcagtaaagaagccggctaaaacccaccaaaaacaagatggtgatgagagtgacctctggtcatcctcactgctacactcccaacggtgccatgacagttgacagatgccatggtaatgacaggaagttaccctatactgtctaaaaaggggaggaactcgcagttccgggaattgcccacccctttcttggaaagctcatgaataatccaccccttgtttggcatataatccagaaataaccataaaaatgggcaaccagcagctccaggcagctctcggggctgctctgcctgtggagtagccattcttttattcctttactttcttcttcttcttttttttttttttttgagacggagtgcagtggggagatctcggctcactacgacctctgcctcccgggttcaagggattctcttgcttcagcctcccgagtagctgggactacaggtgcgtgccaccatgcccagctaatttttgtatttttagtagagacagggtttcacatgttggccaggacgatctcaatctcttgaccttgtgatccgcctgcctcggcctcccaaattgctgggattacaggcatgagccactgcgcccagcccctttactttcttaataaatttgctttcattaaagaaaaaaaaaaaaagaacagacagttccaccaagccttttcccaatgattcctctccccctaggaaattgatcatcatacattagttttgcctgtactagaattttgtataaatggagtcatacaatatatgttcttttatatatgactggtgcacaacaaaatgtttttgcgtacatcggtactttgttcttgctgtgtagtatcccattatgatgaatatcccataatttgtttaatattttgttgatggatatttgggttgtttccagtttgaggattttattgatagaggctctgaacattcttgtatgttgtcttatggacattagcactaattgctcttgcatatgcacacatgtaagagtggaattgctgctgtcactgactttcaacctgtagatttttctctgtgtaaagttgtggcttccattgggtgaggggaggaggtgccatacctgtgcctgaagcctcatttgcgccacactagtcaatttagctaatcagcctgaatcttgtcataatgtagccacctatgaatataactggtgaggcgtcctgatgcacagaacccaatctcccagtgatgatttgattattgggccccaggaactgacaaagactgatttttaatttatttttttattttttttagacagtcttgctctgccacccaggctggagtgcaggggtgggatcatagctcactgtagcttcaaactcctgggctcaagtgatcctcttgccacagcctcccaagtagctaggaccacaggtatatgccacctcacctgggtaattattttgtattttttgtatagacggggtttcaccatattgcccaggctggtctccaactcctgcgctcaagtgatccgcccgcctcagcctcccaaagtgctgggattacaggcgtgggccaccgtgcctgggcgggtcttgctatgttgttcagctggtcttgaactcctgggctcaagtgatcctcccgccttggcctgcccaagtgttgggattacaagtatgagccactatgccaggcctattatattgttaaaaacatacaaagaacatgtgtcaaagtttcgttgaacttatttaatgagggaactagcagaataacaaaacaagctcagtgaggatatgaggaactcagtggaaaaaaaaaaaacctcagtggaaaaaggaatgttcaaataagattgctaagttaggttcaaaactggttcatgtcttagagaacaataaaatctttacctttggggttatcatctctaccagaaaagaaaaaagagaaaacagcataccttatcatttttctacattatcttctgacttttataggattgtaaaatatcctagtagtgttagttaaatcaagttacattttcagagtcaggtgaccctcctggcgggggatgggggggagtgtttattaaaaatgcaatagcatgacattaaaaggtcacatgatcatcttttttgcctagtttctaagttttgggttttttgtttgtttgtttgtttgtttgtttgtttgtttttttgtttaacagaccatgacagaccataatatggggtacaataataggaaaaactaggatgatatcttaaagtcatttaatgaaaaaaaaaaaaaaaaaaaaaaaaaagactgcacttctgggacctcagactgctacctaaaacagaaagccagtcacctatttcaggtagatgtggactctttcacaggggttaattttcccatgttggatttaactaccagtatcttccttttaaaaccttaccctcagatccagacaacattgttctttagtcaagcaaagcatgtataagcagccttttcttctgagttctcctggaagggacccacagctattcattttcaaatgaattttaaaagaaaaaaagccttgaaactatagctcgggctgatgtgcatgtgtctgcctgctcttttaggggacatttgtctgttaggggacatttgataaagttcaacaggacacaggccctcaacattttgtagctcacagatagacatgtggaaggcaggaagctatgataggggttaaaagaatatgcttgttgatctttaaatttatctgactctgtctgtgaggaagtaagctgttttctctgcctgtttttgtatgtgttcggcaaaagtacattttcccctctgcctgcccaattgttgatgggtgaagtgtgtacacttgcagcttgcatgtcctatgtgtgctgagcataaccattctcagctcacttgccgtggcctcagctttcatttgctaggtgttttagatctctctttggcacatttagagcccattttgatatttgtttaaagtggttggtgaatgtggctgttcttttttgatccatgaggcgaaaggccagtattttgcctaattgtaccactccaagataaagctcacagttactttgttcttcttgatttatgaagggatcacaaatctacttcaacaagtgtcataaagtagagattttcaggttactgttctacattcaaagaccctgacatggacctctttaatcatatttcacttttctttaaactttaaactcaagggccattaattttgtgaattatatggatgattgttttcaagatgtttgtctctcttcacaaggtagcagtaatttttctgggtgtgttatgttatgttatgttatgttatgttatgttatgttatgttatgttatgttatgttatgttatttagagacagtgtctccttccatagcctaggctggagtgtagtggtatgatcatggctcactgcagcctcaacctcccaggctcaggtgattctaccacctcagcctcccgagtaactgggactatacacatgtaaccacctaacctgttttttttttttaaattttttgtagagatgggggtatcactatgttgcccacgctggttgccctcctgggctcaagtgatcctttcgctttggcctcccaaaatgccagggttataggcaggagccaccgtgccctgtccaggtatgtattataatgtgcagagcctcatcttgctcacaacatttagtcctggtgtccttgggcatgtgggcatctgctgtgtgttaggcaccagaggatataaactcaaatgagatggactgaatggaatattgtcacaaatgtaacttctagaggatgatagttttagctcctatgacctgcctttgggaattctgtgctttaaacattgttctacaaagatattctgtaaagatgttctggattaaaatgccacttgagaagtttctggctgaattcatccagcaactgttagaatgtgctaaatgaacctacagttagctttttggccctgatggctgtgttactttatggagtaataatggctgcattctattcaaggcttactggctgcctggcattgtatgtataatctacccatgtctgtctgtgtacagtgactaaaatttgttgagcccttactgtatgccaggtaggaaggaggccaagccctttccatgtttttttgtttgtttgttttttgagattgagtctcactctgtcacccaggctggaatgcagtggtgcaatctgggctcattgcaacctccacctcccaggttcaaacagctctcgtgcctcagcctctggagtagctgggattacaggcgtgcaccaccacgcctggctgatatttgtatttttagtagagatagggttttgccatcttggccagtctggtctcaaattcctggtctcaagcaatccacctgcctcagcctcccaaagtgccgggactacaggcatgaaccaccgtgcccagcccctttccatgcttttttatctcatcaaattcttctaccactctatgacaggtaactgaggcatatcagtgttaaaagccatactcacagtcacacaaactagtgaggagcaaagagagcattagaatctaggccaaccagctctgcaacctgagctcaagcgggcagcattatctgggtgtctgaattgtcctgacaggactgtgctcctcaccattattgtctgctgtattatgccttccccaagtgtccattcaggtggaatcatggtatttaacttatttctgtctgcattttaaataattctcttcaaaagttggccctttcaactcaaaagaacaacctttgcctggatttatgggcttgtgttgttttttcctacaaattctgaaattaaggcaattagggaaaatatttcgttattattaatttgtaagcacacgttgttttgcagtgttcagcaggctatgctttctaggagtttgactgtcttttctatcagtggtaaataatcaagatgtgtgactatccaattgttccccatccacggggccctcaaaaccaaccaattccagctcaaattattcttgaaactttaaacatacagttttctttcagaaaaacaatttctaaaactaacaactggaacctgttagattctgttgtgagaaatgttattccaagtagggtctggagtaattaagtacaagtgtgttaccaataagaacccacatcatttggtggtttcttcaggctttgtaactgttgtagtgcagaaaatgtggtggaggggggcggtcttgtgactcagggagagctgtgacctcagtgagttttaatcgcctgactgagttgatcgtggtgattatgcataatggaatcttattttcttaatggcaagattatcgaatcttagcttggaaagggactttaagatcatgtgttttaacccttagctttctaccagatcaaaatctaaaccatctgagatatcaccgtgatcattactggatatttaaacttgttaagcttggggctcccacagcgactccatgtcagtgtgtctctaacctggtcctgctccaggtgcactacgtcatcagaattttgttttgggggcaggagtagggatagaagccttagaatcttttaaaaagttcaggtgattctgctgcttgatctaaagcttgggcattcattttgcacaatggtaccgatagggcagtaccatgtttttaattctagtttcttttctcaagaacatgaattggtagctggtgacttcaattagaaaatattttcatcttatttctaaagtagctttatggataaagtattaatagctatattagtgaatatgtaagtaaacacaatcatgctggaaattattgtaaaagtttactacaaatacacaaagaacatagtgctatgtaaacagtgcttgatttaagtccattagaattaatacattctggctgggtgtggtggctaacacctgtaatcccaggactttgggaggccaaggcgggcgaatcacttgaggtcagaagttcgagaccagactggccaacatgatgaaacctgtctctactaaaaatacaaaaagtagccaggcgtggtggtccatgcctgtagtcccagctactcagaggctgaggcacaaaaatcgcttgaacctgggaggcagaggttgcagtgagccgagattgtggcactgcactccagcctgggcaacagagtgagactatctcaaaaaacaaaaaaaaccaaagagaattaatacattctaattgcggaacttctgtactcagtgattctccatcccactctatacctggtggtagtgagataggcacaatttctagcaatggtcctcaagattctactcttaagtccccacaacttctacatgtgatgagctatcactccagtgattttgttatgttatatggcacaattgatctttaaacagggaggtgatccaggtgggcctaacatgagtccttaagagcagagaactttctcctgtctagtggcagaagagaaagtcagaggaggacttgctgctttgaagagggaggggtcatgtaagaaggaaatgggcagcctataggagcagagagtagaccttggctggcagccaggaaagaaatggagacctcagacctacggccgcaaggtgctggattgtgccaacaacctgagtgaatttggaagtgggttattcttccaagccgccagataaaagtctagcctattcacatcttgatattggcctgtgagaccttgagtgaacaaagaatccagttgagcctatcgggacttttgacctacagaactgtgagataaaaaatgggtgtcgttttagataacccatggcagcattccctcctctgctggaatgtcgtcagtggagactgactggggattctggacttccatccccatcctcccactcagcagtggtaggcagctccccctccccactagagaatggggaaaatcttggagaggagggagctgaagaaaggaattaattaaaggaatattccctgcctgcattggaagtcctgggcaaacaactcctaacccacctgcatgtgaatctgactagaacaaacatgccaaaaagtttagcaatagaaactttaacacagaatatcacccaggttttcagaatgacctctaagtaacagagatgaagcagaccagaatagtactgcaagggctctgaaatcaaactatcgttaaaactgcagccaacgaaaatagcccaggatgtgcgtacttagcctcaatagggttaatgccagctaaaatttaaatagtatctagagtcttgtaagataataacccaagtgcccaaggtacaatttaaacaatcacttgtcataccaagaaccaggaaaatcacaactcgaatgagaaaagccaatcaacagatattaatactgagaagactcagatgttggaattatctgacaaaggttttaaagcatctgtcataaaattgccttaataagcaattccaaacactcttgaaacaaatgaaaaattagaaaatctcagcaaatcaataggttttttaaaaatggaagttattgaaccaaaaaataaacaagttaaaaagctcaccagatgagctcaataatagatgacagaggaaagaatcagtgaacttgaaaatagatcaatgaaacttacttagtctgaacaacagatagaaaatagtctgtaaaaaatgaacagagccttagaggcctatgggataataacatcagatctaacatttgggtcatcagaattccagaaggagaaaagaaggttatgataataaacaatattgaacgaaatgatgactgaaaactcaccacatttggcaaaaagcataaatcttcagaattcagaagctgagcaaaacctaaacaggataaacctagagaaatctatgccaagatacatactaatcaagcttctaaaaatgaaaggcaaagaaaatgcagcaagagagacatgacatatacttacaaggaagaatgatttgaatgacaatgaatttctcctgtaaaataatggagtccagaaggaagtgtacaacattttcatgggctgaaagaaaagaaagattaactctgaattctttgtctggtgaaaatatccttaaggaatgaagagaaaatgaaaacattctcagatgaaggaacactaagagaatttatcaatagcagacctatccttaaataatgcctaaagaaagttttttaggctgggcacggtggctcacgccggtaatcccagcactttgggaggttgagatgggcggatcacaaggtcaggagatggagaccatcctggctaacacggtgaaaccccatctctactaaaaatacaaaaaaattagccaggcatagtggcggccgcctgtagtcccagctactcgggaggctgaggcaggagaatggcgtgaacctgggagggggagcttgcagtgatccgagatcatgccactgcactccagcctgggcgacagagtgagactccatctcagaaaaaaaaaagttttttaaacataaaagaaatggtaacagaagaaactttggaatttcagaaaggagaaaatagcaaatgggtaaaaatagggagtatgtatagtaggccaagtatagggtatgtgtcattaatttttttctgttgttgttgttgagacggaatcttgctctgttgtccaggctggagtgtagtggcacattcttggctcactgcaatctctgcctctcaggttcaagtgattatcttgcctcagtctcctgagtagctgggattacagatgtgcaccaccatgcctggctaatttttgtatttttagtagagacggggtttcaccatgatggccaggctggtgtcaaactcctggcatcaggtaatccacccgccttggcctcccaaagtgctgggattacaggtgtgagccactgtgcccggcttgtatcattaatttttaaaaacatgtttgatggttgaagcaaaaattagatcatctggtgtggtatccaatatatattgaggtaatatgcaagaaaattatatttaagaggtggggaggatgtaaaagaacctaactggaagtaaggtttttacacttcactgaaataggaaaatgttgatcgaagtagtctgtgacaagttacatatgtatattgtaataactaaaatactctaaaaatcactaaaagtataactgtacaaagagatatactaaaactgcctatatataaaaggaaattctaaagaatgtacaagtaacccacaggaagacaagaaaaaggaaacaatgaaaaacagagtgaacaaacagaaaacaaataatacaatggcaggtgtaagtcctaacatgtcaatatgtgttttaaatataccaattaaaaaacagagatgatagataaaaaaaaaaacttgactcaactatatgctgtttgtaagaaactcacttcaaatatattgatataggcacgttggaagtaaaagttggaaaatacatactatgcaagtattaattttaaaaaagcaggagtggctacatataatatcagatagggtagaccagagagcaaagaaaattaccagggacaaagaaggacattacacaatgataaaagtgtcattccaccaagaagacgtagcagtcctaaatgtgtatgggccaagcaacagagctgcaacatatatggagcaaaaactgatagaactagaaaatagacaagtacacagttatagttggcaacttagcatctctttctcagcacttgacagaattactaaacagaaaatcagcaagggtatagaaggcctgaacaacataatcaaccaagaagttgtaattgatgtttacagaatatcctacacagaaacagcacaaaacacatttttttcaagtacccatgaaatatctgccaagttaaaccatatcctgggtcataaaactaacctcaatatatttaagggaattgagataataaaaaaggtgttctttgaccataagtaattaagctagaagtcagtaatggaaagatcagaaaatctccaaacacttggaaatcaaatcacacacttctaaataatccacaggtcaaagaagaagtctcaaaaagattaaacaaacacatagaactgaatgaaaatgaacatacaacatattaaaatgtgtgggacccagctaaagcagtactgagaggaaaatttatagcactaaagtttacattagaatggaggaatgttctcagatcaataatctaaggtcctacctcaagaaactagaaaaagtgaaataaaccgaaaacaaccagaagaaggaaataatgaagataagagcagtaatcattgaaggtgaaaacagaaaaacaacagagaatatcaatgaaaaagccagttctttaaagaccaataggctgggtacagtggctcatgtttgaaatcccagcattttgggaagcgggagtgggaggatcacttgagcccaggactttgagaccagcctgggcagcatagcaagacactatctcgccaatcaaaaaataataataataatcaaaaaattagctggacgtggtggtgcatgcctgtggtcccagctactcaaaaggctgaggtgggaggattacttaagcctgggaggttgaggctgcagtgagctgtgattgtgccactgcactccagcctgggtgacagaatatgatcctatttcaaaataaataaataaaaagatcaataaaatgggtaaacctctaagaagacaggcaaagatgaaaaagacacaaattagcatagtaggaataaaacaggtgatatcattacagattctgcagctattaaagggacaataagcgaatactaaattatatgtacatacatttgacaacttagatgaaatgaaccaattccctgaaaactacaaactaccaaaacttacccaaagtgaaataatgtcaatagtcctataactaactgttaaagaaattgaatttgtcatgtaaaagcttccaaaaaagaaatctccaggcctagaggtttttcgtcataatttccaccaaacatttaaagaattagcaccaattctgcataatcttttcgagaaaatagaagaggagggaatgtgtcccaattcattttatgaggccagtattaccttaataccaaaaccagatagtgcaacaaagaaaactgcaggccagtgtccctcaagaacatagacacaaaagtcctcagcaaagtattagcaaaacaatccagcaacttataaaaaaaattatatactatgaccaagtggggtttattccagatgtgcaaggccacttcagtgtttggaaatcaatcagtgtaatccatgatatcaacacgctatgggagaaaaaatcaaatcgcataatcagatcaattgatgaaaaaaattgacaaaattcaacgccattcatgataaaaactctcagcaaactaggaatagagaggaattcccccaacttgataaagagcatctacaaaaatgctgcagttagcaccatatttaatggtgaaagactgtatactctccccctgagaatggggaaataaggtaagaatgtctgctcttaccagtctcattcaacgtaatactggaagtcctagctagagcaactagttgagaaaaaaataaaagacatatgaattggaaaggaagaataacatcttatttgcagatgacgtgattctccagtagaacatcccaagaatttaccaagtaactcctagaataagtgagtgcagtaaggtcacaggatataagatcaaacacacaatttaatatttctagatactagcaatgaacatatggaaactgaaattaaaaacacaatgccatgtacagtctctcccaaaagaattgaaatacagttatgcattgctgaacaacagggatatgttctcagaaatgcattgtaaggtgattttgttgttgtgtgaacatcatagagtagtatacttatacaaacgtaggtgatatagcctactacacacctagccatattgtatggcctatcactcctaggctacaaacctgcacagcatgttactgtaggcagttacgacacaatggtaagtagttgcatatctaaacatatctaaatattggctgggcactgtggctcacacctgtaatcccagcattttgggaggccaaggtgggtggatcacttgaggtgaggagttcgagaccagcctggccaacatggtgaaaccctgtctctactaaaaatacaaaaatgagctgggcatggttgcctgtgcctgtaatcccagcaactcaggaggctgaggcacgataatcgcttgaacctgggagacggaggttgcagtgagctgagatctcaccactgtactccagcctgggcaacagagcaatactgtctcaaaaaaacaaaaacaaaaccatatataaatataaaaaatgtacttaatacaatagaagtatggtattataatcttatggggaccattgacgtatatgttgtctattattgacaaaaacaatgttatgtagcatatgactatacttaggtataaacttaacatgtacaggatgtgcatgctgaaaacaacaaaatgttgttaatagtattcaaagaagatctaaataaatggagagacataccatattcatggactggagtcagtgtggttaagatgttgattcccccaaattaacctgtagatctaatgcaatttctatcaaaattccagcaagatttttttttgtagctatagactagtttattttaagatttataaaagaaatcaggagaactacaatagtcaaaacattttgaaaacaattttgaaaaagaagagcaaaataggaatctacccaattttatgagttaactttaatagttatagtaatcaagacagtctagtattgacacaggaatacacatatagataaaggaacggactagagaacccagaaataaacctacacaaatatgcccaagtgactttttgacaaaagggcaaaagcaattcaatggaggaaggatagccttttcaacaaatgatactggagtatttggacatccatagacaaaaaaagtgaaactcggcctaaatctaacatcttattaaaaaattaactcaaaacggatcatggatttaaatgtaaaacataaaactataaaagtgttagaattaaacataggcaaacattttggggacctaggcctaggtgaagagttcttagatatcataccaaaaacaaaatcttttttgtttttgctccgttgcccaggctagagtgcagtggcacagtctcagctcactgcagcctcgacctcccaggctcaagtgctccttgtgcctcagcctcccaagtagctggaactacaggtgtgagccaccacgcctggctaattttttgtattttttgtagagatggagtctccctatgttgcccaggctggtctcaaactcctagactcaagtaatccactgccttggcctcccaaagtactgggattacaagtgtgagccaccacacctggccaacacaatctattaaataaaaaaagatcaattagacttcatcaaaatgtgaagaggatgaaaagataggttacagactgggaggaaatatttgcaaaccacatgtctgacaaaggacttgtatctagaatgtgtagagctctcaaaatgcaacagtaagaaaccaaaacaatctaatgaaaatgggtgaaatacacgaacagacattcactgaagagagtatgcagatgtaaaataagcacatgaaaagatgtccaacatcattagtcattagaggaatgcaaattaaaaccacaacaagaaattactatgtatctattagaatggccattaggatggctaaattaaaaatggtgataacaccaaatgctggcaaggttgcagagaaactggttctctcatatattgatggtgggaatgaaaagtggttcagtcagtttggaaaatagtttggcagtttgttatagaactatgtgcttcccataggatgcagcagttatacttttggacactcatcccagagaaataaaaacttaagttcacagaaaaacctgtacacagatgttcatagcagctttatttgtaataattgcaaattggaaatatcttgaattgtctttgagtggatgaatggttaaacaagttccggtccaaccataccatggaatactactcagcaataaaacagaatgaactcggatacacacaacaacttagatagatctcaggggcatcgtgctgtgtgaacaaagccaacctaagatgttacacactgtatgatttcatttatattacattctcaaaatgacaaagctatagacttggagagcagattactggatgccaagggacaatgacagggtgtggggaagactggtaccacaataaaggggtagcatgagggagttccttttgaagatggaatagttctgtatcttgactgtatattgattgtgatccagtgtgtagatttgtgcaaatctacacattggatcaagttgcaaagagttacacacaaatcagtgtatggaatgactgatgaaaacggaataaggtctgtagtgaacagtattgtaccaatgtcaatttttttgttttgatattgtactatagtcatatatcatcactgagggaagctaagtgaagggtttatgggactccatgcaccgtttttgtaagttcttgtgagtagataattacttcaaaataaaaattaaaaaaaatctccaatgggtctcaaccttggcagcacacaagtatcgcccaaggagctttaaaaatcccgatgcccaggctgcatcttagtctcatctttatctctgattgtgagtctcagcattagtattttttaggatttctaactcttgtccttgttgttttccattaaattaaaaaaataataaccaccaccaggaccataccactttcccatacactgcagttctccagctctttgtgggtgatgggtgatgggtgacagattacaggtgtttcagttctttctcaggaggtcagactctgtcatcctgttgtcatgtctgaggctgggatttggggaagccccacccccagctttgagcaggtccaaggaggcattatcacttggcctgtctgtggttggcctggagactggagggccaatgacagaagtagagttgggaggagaaaagaaggatggaggaagagagaagtgggggtggagtgtgagaggatgtgggcctcagagaccctgttgagcctcaccctgggcctagtctcttggagcaagcatgtttgaggaggagaaagaaggggaggggaagatgaatgttggggatgggattgcaatttatgatagggaggccaggaaaggcctcatgaaaaaggtgatttaagtcaagacttgaggatgtgaggaagaactttgtggggatctgggggaaagagcccttcgggcagtgggaacggcacgtgcaaaggccctatggaggagggtgtccctggcttgttggaggaacaacagagagaccagtgcaccaccactgccggagggaagagggcaggggagagcaataggagaaggggttagaggacataggttacagggctccagatcagggagggccttgtgacttgtgactctgagtgagatgggaagtaactggggaggctgatgcgaccagagatgttttaacaggttccctctggctgccgtgttgagaaaagactgcaagggggaagggtggaagcgaggagagcagtttggaggccctttgcaggaatacaggggagaccagggggtggcagtgggagggtgagaagtggtcagattctggatatttctgtaagtacagccaacgggatttgctggtaagactgggggtgtggcaggagaggaaggagggagagatgactctaaggtttttgtcctgtgcattgggaagcatggtagggatgtgggtctggagtgtgggggccaggtccaggctagagataggaatttgcacagctgcccggctgtcagcccaggcccaccacagaaccacctctggcactacaattcctgtttgatgcaaggatggctgcttttcttacctgtcaccctgtgatgtgaaatcatgcatttagagcaacttggtaaatattaatttgtcaacaaatattagctattaatatcagtattaagccactccaagacactggagaaatacttagatggtgtttagcagtttggtactgtaggattcggatgctgagatggagttaggagtagaggaggtttgtttgggggctggggggataacacccttgaaggatgagagagcagaggagcagggcagggagagcctcaggtggtgatgccagtctgtcctggccagcctaacagggggcttctggacaaaaattgctccatgaaagcaaaggggagatgctagccaaagggcacaaacttgcaattacaagacgagttctggagacctgctgtgcagcacggtaactagagttaataatcatgcattacatacttaaaatttgagagtaactcttgcgtgttcttattacaaaaagggaactctgtgaggtgatgagtctcttaattagcttgattgtgatcgtcatttcacggtgtatatatatgtcagatcatcatgttgtacaccttatattaatacaatttttctttgtcaatcatacctcagtaaggctggaaaaaaaaaaaaagaaatgggcagaaatggccaggctctaggactgcactccccagattagtgaccagctgttggctcctcagcgagagcatggcctctgctagaaagaaagctgaggcagattccaaaggtgcaagttagttctttccttcttcttcttcttcttcttcttcttctttttttttgtttgtttttggagacagggtctcactctgttgcccaggctggagtgcagtggcgcgatcatggctcactgcagcctcgacctccaaggctcaagtgatcctcccacctcagcctcctgagtagttgggactacaggcgcgtaccaccacatctagctaattttttgttgttgtcttttgagacagagtctctctctttcacccaggctggagtgcagtggtgcgattttggctcacagcaacctccgcctcccgggctcaagcgattctccttcctcagcctcctgagtatctgggactacaggcgtgcactaacacacctggctaatttttgtattgtttgtagagacaaggtttcaccatgttgcccaagctggtcttgaattcctgagctcaggtgatccgcccaccttgtcttcccaatgtgctgggattacaggtatgagccaccatgcccagccccagctattttttttttttttttttttgtagagacggggtctcactatgttgcccaggctggtctcaaactcctgggctcaagcaatcctcctgcctcagcctcccaatgtgctgggattacaggtgtgagccactatgctggccaagttctttcttgaaggaacatatgggcagtacatctttagggctacccagaagacattttgtttcactttagcttcttaactcacaaagggatatgaaatagtatattgccccactcgcaggctaaggggtaaatttcatcatctttatgccactgagggagatgagataaattcttgaggagagttcagggagagtgaaggtgaagatgtgaaagtctctttaatgtgtagtcacaacatgtactagcacaaaagtcacacaaacacacagttatttgtggaatgaggtgtatgaagtcagcccgtttttgctcttagctgtctattttgctcgtcatgaaggagagcttttcattattgtcatacttcctctgggaccaccaggattttctcatgaagactaacaaagagatgatatcatgtgtctgggagtcagggtgaaaaacaaagtgggcttgcctgagtttgtaagctgagaagttgtccgagtcaaaccacatcctgccctgggtttctagaggcaggtggtcccagatggagacccagagcgggaggaactgtgccaatgctttcctaagagccatgctcagttcccaggaggtgtgggggaggccctggtgactatgtcctctttacactgaagttttcttctagggaggccacaactcactggttgccagtaaaggttgtgaagttggttccagttccagttgtggctgtgctgtgaaccagctgtgccactggtggccatgctgaagctcttggggttgtacttttcctggctgtcaaacgaagccatggtcaaggtctgagatagctagtgcaggtaggtagtatcggcgcagtgggggccaagtcaaaaccaaagagggactgtttttgcgtatcatggaagaaaaagtaaattaacattaaaaccatgtttaaaatatttattagatgtacattttagttgtgattatactacaacataattggaattgatgaagtattaacatgtgaacatattcttagcaaagctggacatgtttggagagtaccttgtcaagagtgtgatgcctgctgccgaaggcttcggtccagtgggatttgctttctgaccagataagattttatctaagagacaacatccaaaatcaataggctgacagattattggtaaaagatacattacagctgtttaaaaccataaacgctatcaagttctaactgctaagcctgtagtcatattgtaatatcgggaccctcatgggcacagatatgaaaggaatcaggatggtagctgtcgttctgtaattgctgtttaacagcctggcttatattcatgattcaatctttttttgtttttttcttgcttccacaattcaatccttatttctgtaagctgcaaaatcgtgagtgtgcgcacaagtttttttctcccccggtcttgaaactggaataattgccaatctgcttattaaaaaaatacatctgccctatgaaagtagtttcagctactctgtgttaaatgagtgattatgacattgggctctggtggcacgtaatactaatgctgaaacgcttgaatatggaggttagtgtggtttcagatgttgagaaatcacttctttgtgcttattgacatttttccaaggactgctctgttatttggcttaaaatgtcacatgacagctgatctctttggtgcatataatccatgcaattatagtgtgagcttctgctgtcagtggtggttaaaaatccatatacctcactccttttttagcctctgattttttttaattcaatttaactcatccttttattttaaaacttgaatttgaatgggttccattaacagatattttaaggtgacaatcaagtctagggcgctgccagcttgaagctgaacacagtccctagccctcaagctggatgtgagatctaatttagggcatgttgcaatgcagagatgtagctgatttgtaaacagcccttgtgacaacgtaatacagttgacaagtgatggttctcaggcagggtgaagtgtgttatctagctgtctgagtgatcaccctgattgcagttccacctggggttcatctcacagagccacacaggataattaaagccacagattcatcattggtagattcagcccattttagtctcattacagacaaatttagtcctgtcttcattcattataatgaaagtcacacgaagattcactttactataaactatattctttttcccttttaaatggaacgtacaagtgaatgttaaagtataaaagtacttgcaagtcactcgctttgctaatgagaatgtatgcaaatgtggtgcatgtttgcctttcctggactcagccctgtgacccatccctgtgtctgtcctgatggcagggattggtagataacttatgttggcccatctcttcccagagtggctagaatggtcttacggacatagaaggacatgttaaatattcatctggtttaattgaatttaatacacaatccttaagattaatctgcacttctggagttattaaatggctcactttttagtagcatatcatttatttgctattatctgagatagtgaattatttaagtaaaaagggaatgttctttccatgaggtggatcttaccaagctgctgctgctttcatttacaggcgattaccaattatattaaattaggaatgtgggtaaaaggaagcatggccgtctgaaggtttaagatgtttggttactaggtgttgcataatgtactgcaatctgggatctggcacttgctggttgacctatggtctgctggcacatgcattattaattatcgttttccatgaatattaatgatggttggatatcagtttaaagaatagtgaatcaattaacatgtaattttcatatactttgatttataaacatgcacattttaagatacatttgttttcttttagaacattaatttttccatttcagtttctcctttcccttgatactgactttttttttctttctttctttttttgagacaagtcttgctctgtcgccaggctggagtgcagtggtgcgatctcggctcactgcaacctccgcctcccgggttcaagtgattctcctgcctcagcctcccgagtagctgggattacaggtgcacgccaccacacccagctaattttttgtattttagtagagacagggtttcaccatgttggccaggatggtcttgatctcctgacctcgtgatctgcctgcctcggcctcccaaagtgtggggattacaggcgtgagctaccgtgcctggctgatactgacatttaatggtgtattggagtgatttatattttttcaggacaatttctgaagcgttgccaaaaatgctggttgtattttaaaattcaggtgatttctgtaagttattgaacaagaaccaagtgctgtacacatacctcagtctatttatattatagtactcttttctaccatggccacctacaacttaattttataatttgaaatgttactgaaccatgaaaatataaaagagcatataaccaacatctagctacccactacctagttctatcaaatgttgccattttgtcatacttacttctgatccttaaaaaaataaataagtagacttctgatttcagctcagagatgtagagagctgcaaagatgtccctcccacgcttccaagaaaaaatctggacagattggaaattaacagagaactgagtttgcagagcaaacgaccatttcaaaatctggaaagaggtgccttctgagacacaggacaggacctgagcatttgtttacaggagcagaagccaccagaccccatagaagtaggtaggaagattaagctagaaaatttgacaaattgctggaggctgagtgtgggctaacttgagagtgtgaagtcttgagggcagcagttgtgggggagggggtcctatccctttgcaggcttttcttccaggaaccccatttggctctaactgggagggtgagggaaaattcagagaaaactcatggtgctggctcaggaaccactgagcaatctacttagacccttctcctttaaggagcaaaaggcttattctgcagaggaaggctatggtctgagggccctggtgaattaaccattgcagatgggggatggagctccccttcagccccttccccactccatctcacctaaaaaaaaaggtctttaagcgggtggtagactgagaacattggtgatacctgctacagctgggggtttggggtgggaggagctgtatccctagggcaaatacgttgtgaagcctacaccttcaagacacaggcccgctgtgtatattttagagactgagacttgaaatattagagaactgcccttcttccctcaccccacctgcaggctagcaagcccccaggaataacagtgggttacagcagggagagctgcaagagacaggctcacactgggaacagcataaaggaaagccccaaagccaagagaggggacaaaaaaggtcactagaggaatttgaagtttttgatgttcataggaacaacaaacctcaacgcagctcaactcctgactagattaatatcagttccacactaagggctcatttaccttagtatctgctaccttctatgaaatgtctggctttcaaccaaaaattacaaggcatgccaaaaggcaggtaaaagcagtctgaagagacaaaacactcagtagaaccagatgcaaatgcgatatagctgctgcaacgatcaaaacacacatgtatcttacctagctctgtccactgagtgccctttctgtgacaggtgccattttaggagccatttcagaatgagcttaacaaggtctgagcttttagagagcttacactccaacagagtacagagagcttaaccacagacaagtgaaaagataattatagatagtgaaacatgcagccatgaagaaacacaggagaggaaaaggctagagtggctagagtggctggtggagtgtgtgggctgtttcaggtgaggagaagttggagcccacacgtgaatgatgaggaagaggctcctgccattgctaagagccatccaagcagagaacaagaagcataattgcccagaggcgtgaacaaggttggatcctccctcggtctgcactgttgccttggaaggtaaaaacgctatgggcatggtgctgattacagcaagctttacaattgtgttgctgtcatggccaacctctagggataaagtggtgggtgagttttctttaaacatgtgtaagaattacctgtcttcctccattttgagggacaaggagaatctgttagatcttgtttgtaaccacttcaggacctggtacagggtgaaaaggaatgtgaatttgcaattgtgagtagatactgcatcatttatccagtgcaactgtattgttctttgtattaactcagctactccttaccctccatcccttgccccaagtagtgattattcctatgttatagatgggaaaactgaagctcagagaggttgcctgacttgaagattgcagatctattaagggtcaacccagttatttgaactctggcagcctgacttcccaggattgtgttgtgagaactaattagaaggacaggtattcttaaaagtggagcctctgatgaaaaagaaaaccgaaaaccaaacatagttgtaaaattcacgtactaagtttatgtgaaaacattggctgctgaaactgcctaaggaaatggatttagtaaatgcatgttgaactatctatcacttgttcatttgtcatgagtgcttaaaatagatgaaaatgggtaaatagttgcaacgtcccaatttctgctgtgtcttactacacagcagaatactatacagtgttattgtatagtattaataccgtgagggcaatgttgtctgacacttccctacctggaacattctggaaatcactttttgtgatctcaataactgttaagtaattggtaccagtctagtgggttgttttgtttttgagatggagtctcgctgtgtcgcccaggctggagtgcagtggcgcgaactcggctcagtgcaacctccgcttccctggttcaagcgattctcctgcctcagcctcccaagtagctgggattacaggtgcacaccaccatgcccagctaatttttgtattttagtagagacagggtttcaccatgttggccaggctggtctcgaactcctgacctcaagtgatccacctgcctcagcctcccaaagtgctgggattacgggcataaactactgtgcctggcccagtctactgttttgtagactgcatttttcacctgctcaaatgcttttcatactttttctatagtagtgtttattttttgagaagatatgagacataaaataaatgaaccatattaagtacatgactggagagggagactgttacattggattaagaagatgcttgtatccattggtttttgtttttcaccattaggggaagaaaaacaccttcccaagagtacctttcttgatacaccaaaaggttgctggtatttggtaatgatatattcattgagggaaataccaggtgaatggagagttcttcaaccattagcaataactgagcacccactgtgtgcatagttcctttatctgtaccattcatgggactgcatgttagatgaggaaaacagcaaacagcaaatttttatatagcacttcccagggaccagagacattaagtaagttgcccaagggagcacagattgtaaatggcaggtctcgacgtgggctggtgggtggcttaactccagagtctgtgttctctcacccctaattgtactatggtatagcattgtctgggtggccttggctatgttcacaaacctcaaaccagacggtaattagcatgaggggcacccaaatctgtcaggttcggagaacttctgggagtcttggctgagctctgtgatagggtactgtgaggtgtttttttttttttttttttaatatgcagccatgtcttaattgaaaccacaacttcctgtggatgccttatgatgttatttgaacaagggaaataagcacatgaatctttaaaaagtttcaagtatgttgatttttaagaatggatgcaattagtagttctcattagctccacaaattatttaccgtggaatgctttggttccacataaagccctttaacgctaaaagattttgcaggttctgctgctttgactatctagagctgatttcgactggcagctttaaacatgcgcagtaatgcaagtgccgatgctgccagcacaaatggaacaatgtattgctttaatttaaaaaacaggctttgtctcatttttgactccctttacatttaatctgactagtcatgttttctaggaggatggtgagggtgagagcaggatttgactctgttgttcatcaataaagatcctggaaaaaactggaatgtgaattttgattgtgccctcccatttgtaaaggggaaacaaacaaaaaacaaaaaccctagaagattctgaggccagacgacagtgtagccttaggctgcctaaactcagatgtgcccttcttcctaggatcttgttaaaaggcagattgtgatggcagcgggtgggggggggggggtagggtttgggctgggggcgggtaggtttggggaagctgagattctgcagttctaagaagctcccagtcgatcctccttttagtagcaataatttctgacactttagacctagctctctatcttctggctgtgtggatcacctgggggagtttaaacaacacagtttctcacagccacaccagacctattgaatcagatctctgcaggggtgaaaccagcaggtatttggggaaaaaaaaaaaagctatagaaatcatttgataatacatctgccagctttgtttattggggatgggggagtaatgacagctttgaaaacttcactgttggaatcagattgagatgtttaaagttaagctttttgacatcctaagggcttccactccaaaactacatgagctatcttagcagccacccatcttggaagggaactcactagttctttatgagtatgtccaaactggcttagatcagagagagtggaggaaaaaaagagtacttaatggttagcttgctgacctgcctagcattagataatgtctgtgaaggcccctggagtgcctccagggaagccggggcccaaatatggaaaagagaagtcatgattatgaggtaggagttgcaattaccatcgtgaatatttaaagtgttatttcagctctttcctacgctcctgggtttggggtttcatttctttttcctttttttttaatatggattctcactctgtcgcccaggctggagtgcggtggcgcgatcttagcctactgcaacctctgcctcccgagttcaactgattctcctgcctcagcctcccgagtaactgggattacaggcacccgccaccatgcctggctaattttttgtatttttagtagagatgaggtttcaccgtgttagtcaggatggtctcgatctcctgacctcgtgatccgcctgcctcggcctcccaaagtgttgggattacaggcgtgagccactgtgcccagcctggggtttcatttctagcagtgtgtggggagccaggacaggttagaaagaagggccaggggatgtctttgttgtgataaagcagataccaccatggagttttgccactttcacggtatgattttattttattttattttttttgataactgagacaccccagcaagtgtcttcttaacatttcgtaaatcttactattaatcttttcccctgaggtcaagcaggaagataagacaccaggtagagacttagctttcgccctcctcaagctattgtgtctctcttttaacttggagtctttctttaaaaccaagtgtttcccagtgttgcgtgtgtgacttttcttaactccttacattatctaaggattaaaaaaataaggggctgggtgtggtggcctatgcctgtaattccagtgctttgggaggtcaaggcaggaggatcacttgagaccaggggtttgagaccaacctggccaacatagcgagaccttgtctctacactaaatttaaaaattagccaggcatggtggtgtgtgcctggcttggcacttgggaggctggggtgtgggaggattgcctgagcccaggagttagagaccagcctggacaacatagtgagacaatgtctctaaaataaataagggaaacctcacaatcagaaaaataaaaaaagttggacattccctgtcttccttttctgaagcttctacggtgagagatgttgtgcattgtcaccatgaacttctgtgtcagggagggttggagccgagaagcagagcgctaagtgtgatctggataagggatttcctgcacgttgtggaagctgccagtgcaagctgccccctgtgtcctgtactgagtctgaagtcgctggaggaaggtgggtgtggatgagagcaaggactcctggaacctgcctctggctctcacgcccccaacctcaatgacacagtgccctgtgggagagattggtgcccttcccgaaagagaaagattagcccagtccagtgggcatctgttgagtgtctgctatgtcttgagagctgttctgggccccgggggagagcatgaggggagagactgacctggaagcacacttttccaacccgttgtggtgcgtgcccagtacgctaagggagcacaaagggagggggacctaagagcctggggcagaagaggaaggaatttgatcaggtgaagaggacgggccagagcccagagcgagtgagaatgagggtatagtgtgagtgtgaacagaggcctacagcttgatgagtacctagaaataagccttgccagagtaaaatgggaagcaaggccagaaggtgagagggatcttgcacgcccttgaaaggaacttggacttttggggtaattgggaaccactgaggcaggattctaagcaggggtatgccgcaccgtcacatgtggatggaggaaagttccttcaatctgtgacctctcctgaatgagcacctgctcccaggcaaggtttttatttatttttattttattttaatattttggagtgcagtggtgcaatcttggctcactgcaacctgcgcctcccaggttccagtgattcttgtgcctcagcctctcgagtagctgggactacagacatgcgccaccacaactggctaatttttgtgttttcttggtagagaccgggtttccttgtgttggccaggctggtctcgaactcctggcctcaagtgatccgcccacctgggtctcccaaagtgctgggattacaggcatgagccaccgcactgagcctccaggcatgttccccactggccacccctccccgagacagagccttgctctgtcgctcaggctggagtgcagtggtgtgatcttggatcactgcaacctctgcctcctgggttcaagtgatccttctgtctcagtctcccaagtagctgggattacaggcacctgccatcatgcccagctaatttttctgtattcttagtagagacagggtttctccatgttggccaggctggtttcaaactcctgacctcaagggatccgcccacctcagcctcccaaagtgttagaattacaggcgtgagacactgcacctggcccaggcaaggttttagaaacagctttgaggtctaatttacatgccatgatattgacctaatgagtatcccagtcagtgctttttaatatatttacagagttgtgtgaccatcttcacaatctaattcttgaacatttccatcacccccaaaagaaacctgtgcccatttgcagtcactctccatttccacgctcagccctaggcaaccactcacctttgtaatttctcctttttctttaaggagaatgttttctgcaaatgtattatttactttaaggagtctcccaaattataaactcttactcttggctacccggttagttactgcttagcctgttcctcccagcacacttgagattgcatggaacagaaacctgtctgggactgccttaaacacagacatttgttattttgcataattgggaggctagaggtagggtggaccccaggggcagtgtgatcagctgctcagtgtgacatcagaaacctgtgttcttgctgtctcttcccccaccgtgttgttctggcagtagcttcacccaagggctggcttccctgtggtcatcagatggttgtagaatggtgtccatctgcagtggggccctttgcttccttgctcacagcccgtatgtaggaggagttatttcttgcagtctgattgggtgagctttgttccccctgcccaccctgaagcaatgattggcttagaattaattaggctgtccttcctagagctggaaatgggctccatgggggaatggatggcacctgtgaccaggagtgggctctgctggggaaggaggaagggagccagctctactgggtaggcaaccagcagtgctcactgagggttcctgaccaactgcattggattgtttgtttcctttcacttgggggccttttttatgttaaatgcaagcaaggtgatcctctgattttgaacttgttatctgggggaaggcagaccaatcccagttcatcctggctgagtgacagcggatttgatcgttgatctcaataggcttgagagtaataatatgtgagtatttttgaagctgaccctaactttacatctctgaaaagtatcaattcagatctcactaattcaggaggttctgataatttggtcaagaagttcgctgaagtttacctttgaacagttttatagtgagggtaatattggtgatggtggtaacactaacatatgtgggaaataaatgatttgagtaacattcgaaaaacctgtttgctttaggatagaaatatctaaatatacgactagaagtaaatagtagaaaatcattcctatctagttattaacttagtcccttggaatctctccttggggaaaaaataaaatcctgctctgactatgtcagtatttgaattactgtatgaacctgaaattaacaaaaatggactttcaagtataattcatgcttcactgagccaaatagacattctgccagttatttggactttattaaattttactttattacttatatgtaataaaaaatcaaggtaagcctctgctttgcgaagtcatttatttgattaggagctgtattttagagtgcatttcagggcgaggtttgtccacatgtaagtaatgaacgtttgctggtgcagctcgtaatggtgagaacggatgttgaagaaagcaaacaccatatgccctttgtttcccgtgcatgtcctcttctggaggcctgggtggagtgtttcagctgtctcaaataatctccattttgctgttactgcagactctgcggttctccagctctctcctctctgatgttaattataacttcttcctaattaggtggctcttcctcctcctcagtcatacaggttccacactctcaagtgccagagattggattacttttcacttgatttgcgacagaaataagtgcaaagaattacaaaaaaaccaccagtgtgagtgtgtagtgggaggggcaggcgggttgggtacgggacaggatgcttagaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgtaagtaggccatacatctgttttgattgttgcgatgtctgcatcttttgtagcctgttgcccgactactttgtaggccaggagggaggcatgatggggaatttggtctcaggccagtccttccaagatggtgaccaacactgttttccacttggccccaggtctcagttttctggtttatagccgaagggtatttctttcactaagcccttgtctgtgatagaagtggattctttggctgagttccttttgtagtggcatttataaagattttgaatagctctgtcatctggtttggtggctctttccctctctgatcactatcgacagccaggtgagttttctccaggggacacggcacacagatagctgcattcaaccaaaccccctgcaggcatccatttctgcagtgaggtacccctctcaggggttgggagcaggtaacatttctgatgcagctggcagatctgggaatctaggggggaagccaggtgtggaatttagctttcctgtagtgtgaagaaataaagggggtgggggtaagaatgagatgggagacaggagagaaagtcagcttggggtctgtcaagagcactgtcctgttgccagatgccaactgaggtgtcgggagaggttcagttccccactcagctaactgtgcagccatgggctgctaaccaagatctctccaagtcttacttttctcatctgaaaatctgcatcctaccacctcgcaggactactggattgtttaaagtaatgaatgtgaaggcacctggtgcttggttgccatccttctccttttccatggcactctatgccataaatgcaagcagtgtgctgggctctgtgagatgccaccagtgttgctgtcctggcttgtttcaggccatcttttgtggccaccaagttctcatggtcagtgtcataggtttgatcttggggttggccagttggccttgcttaagtatgtagccccaggttgcccttttagtcatggccaggtgacccgcctcccaaaacaaggtcctggggaaagggtatgagtgagtcatggttatgtctcatagctaacgtttaagttaaagatgatgggaactgaggacccaagttaggaggctgtgttacaggtccttggggagagtgataattcaaaagacccctttcccgtccagctttgagtttccaacttattaaaacctatattcagccagagggagggagaaggaaaacaaaaggtaaacctcggccaggcacaatggtttatgcctgtaattccagcactttgggaggccgaggcaggaggatcgcttgagcccaggagttcgagaccagcctgggcaacatggtgagaccctgtctctaccaaaaataaaaaaaaattagccaggaatggtgacacacgcctgtagtcccagctactcaggaggctgaggctggaggattgactgagcctgggaggtcgaggctgcagtgagccatgatcacgctactgcactccagcctgggtgataggagtgagaccctgtgtcaaaaaaataaaaataaaaataaaccttgattgaaaactgccgagcagtcatctgaattctgattcagaagtacatgtaggacaccgtcatggtacttttccattgtgttgtttcatttaatgtgtttatgaatttaggcagccaccatgcacgtcggtcaagccccagttgcctttcgtgtgtgtgtgtgtgtgtgtgtgtgtgtgtgtgtttagggcactttctagagcctgctttgttaattaactgtactatgtgctttatatttgctgtgagttaattaccgatgatagtgttcccttgccagtcacaagttctctcacccctttcccccattgaattcctcatatttcatctcatccataggctcaagttgtttgtctttgactggcaagactcctcaataatcgtgtatcagtgatctctgacacagtgctaacttttatcactgattacggagagacattgtataaatcatcaggacagtttgttttgcgtatgatgatttaagagcacctcttaaccaacatcaaagtaatatatcagagtgccaaccttcggtacttttcttttgcttttcattgaaatccactttcttttctatggtctactgggcctcgtatggtctggctttgcctaccttttcagcctcatcggggtcatcttcccactcggccactgccttctgccatattgagttctcgcctgtcccagcactgtctctgcgtctggtcacttgcaattctcactgctgggaatgcccctttttttctttttggctccttgcttggctggccctttctcttctttcaggtaccactctgagcagccctccagggccatcttgtctcaagggccagcctccatcttgagtttcctttctccattcccatcacatcaccacatttatttcctttgcagtccttatatcacagcctgtaaatattttgttaactcattgatggacttggtatttgatgtctctcccaccagaattttagctccatgagggcaggggccttgtctgtcttatccctaccatatccccagctcttaactcaattctagatgcatagtaaatgctcaacagatatttgttgaatgaatagttgctttggataattaacacggtgaattacttttaagtagtttgtgactgcaagctgatagagccagtcccatgttttatgtggctggccccctccccatctgcatccatcactgctctggcactttgggagcatttcagaccccagggcactatttctctgtcttggccagcccctggctggtgtctgggataaccctctgttttaagcatcatttttgttctcaaaatgaaaaccacctgtcttcaacgtgatttgcttaaaataaatgctttatttctttactgagaccttcttccctttctgcctttctccacctcctgccaagaataatgtgaaaaaccccattatcttggaaagtggttttccctctggttggaatacaaagccagatgacttaccaccaaatgtgctgggataatagctttcccctgccctgatgctctcagatgttagtgaggtctcgaccttggcacttcctttctttgtatatttccttgaaacttccttcctacaggtaaagaagctagcccaaggcaccacctaaatggcagtgggggtagggaccatgtctaagtagcactctgtggcagactgtttgccagctcactgacaccttacaccaattccagggagttgacagtttttaccaccattttagagatagcaaaatggaggctcactgaggttaggtgacttgttcctaagcacataggttgcaaccagccaagatcagaaaccaggcttgtctgactcccaaattcatcttttatttgttgatgtactcagtgtctcccagggctatatcaaccaagttctgcagttaaaaaaacatctggcaacctggtctacggtacacatcccatgtaactgaggtaagtttcctgaaacagtagctgccttcactgtgtgtgatgccctcttgtattctccattccattcaacagatgcttgtcaggaccttctaaactgattacgtggcccaccgattggtggcagtccatttgaaaacagtttgagggacattagtgtaggtgaggtgtaaactatgcttagtttatatagaggtttacatggtgtaagctattaaaaagaatttttatggcaatataatagacatacataaaatgcgcatgagggtacggctgttgaatttttacaaactaaacacatctgcataattagcacgagatcaaaacacacaccattgatttaagcttctttgaatcaagacagaggcatgaagtacaacagaaactgatagcccctcagtttgttgtgaattacgcacaaacagcttactccataggcagactctttttggaggtccgtagcttgcctttccagtgatggggtctggctggtatttgtttgagatctaagaattgccgaaggagtggaatatggcctctgtaatggcctcagaaattagcacaaaaggagggctgactgagaatgtgcctcgtaaaatgtgaacatggaggaggaggaggaggaaagggcaaggccccgtagttgagtacagaaacattagggtgtgagaatttgtggtcatagtaattgagaccaattttactgaaatggagggcggcaaaaggaggaaggaaaaggaatttgtgattacagcaccaagcccctagaggttaaagaacgtctctgtaaaataaggaatatctacctctcatggtgagtgttgacttttagagaaaattgttctagtatactgaactaaaatgcttaattcttggcaaaagatacagatgcatctccatgcaaaagcaagctaaagcaactttgctttcataatgtatgggttctgtaaagctgtcttggtggacatgccatatgtaattcatcataatggggtgtgcatagaaatgaaagggagcgaatatcgtaacatgccttgaagcattgagtgctaagttacaaagggcattaattaatacaacttaatgggattcatttatagctcacttttagtcaaactgaaatagctttcctgaatcagggactttgggataataataaatccttttgtctttgttgatcagataagctcttattcactgacttcctgttactttcttggcacccagagtcatgcctgggcactaaggatttgctgaatgaatggaaggagtaaggacaaaaaaaatcgtagctagcatttaatgagtgtgtactgtgtgctttgcctcttttatctgatttagtcatcactacaaggctgtgaggcaggcactgttatcattttcttctttattttattttattttatttattttttgagatagagtcttgctctgtcgcccaggctggagtgcagtggcgctatctcggctcactgcaagctctgcctcccgagttcatgccattctcctgcctcagcctcccgagatgctgggactccaggcgcctgccaccaagcccagctaattctttgtatttttagtagagacggggtttcaccatgttagccaggatggtctcgatctcctgacctcgtgatccgcccgcctcagcctcccaaagtgctgggattacaggcgtgagccaccatgtccggcctatttatttatctatttattgagacgggatctcactctcacccaggctggagtgcaatggtgcaatcacagctcactgcagcctcgacctcctgggctcaagtgagcctcccacctctcagcctcctgagtagctgggactatagttgcacaccaccatgcctggctgattttttttttttttttttttttgtagagacagggtttcaccatgttgcccaggctggtcttgaactcctgggctcagtgatctgcctgcctgggcctcccaaagtgttgggattataggtgtgagccaccatgcccagcattatcccttcttttagagccaccttatttcctctacttgcctggggaccgttctggtgtatgcctgttgtcctcgcattaacattgacatcacctgctttcattctcagatgtcctggtcagatgataaaccatttcactctgaaatgttctggtttggatagacagatgaggaaactgagacacagagaagccacatcactttccatggtcaccaagctagtaagatgtaaaggtgggattctttcctgggagtctgattccaggtcatgttgtctgatcactaagttctggtgcttcacagtttaagccaagggagagataatataggaaaaccactctttatgtttttcagcttcagtatttagtaaaaatcactgccaagttagcatctgaagtaggttaatgtgactcagggcagtgggaatgtgctaggtaaagactcattgaaaccctaagtgtgtgttcattagtaaacttggccaactactaccctagaatgataatagcattcacatgtgcatggtgctttatagtttacaaaacctcttctcccatattattgtgttgaagcttcttgtgcactcagaggtgggaggtggatggccagtggtgggatttccagtttatagaggaggatggggtaatcagcaggatagtacagttgcctgcctgaggcttcacggctagaaaagaggcagatccaggattcaacccaggtattccgcctcagcgatcagtgcattcccactttagcacgggtgcctcttagccagatatatatatatatatatatatatttttttttccttgagacaatgtcttgcttgctctgtcacctaggccagagtgcagtggtgtgatcacaactcactgtagcctcaacctcccaggctcaaacaatcctcccacctcagcctcccaaatagctgggattacaggtgtgcaaccaccatgcctgactaattttaaaatttttttaagagatggggtcccactatattgctcaggctggtctggaattcctgggctaaagtaatcctcccacctcggcctcccaaagtgctgagattacaggtgtgagccacccatgcctggcccagatgctcttatatagccatttgagggtgctgtttatgaagggttagggagtcacttgaagactcatttacccagagtttcttagccttggcactgttgatattttgagccagttaagcctgttgtgggggctgtcctgtgtgttgtaggatgtttaggagcatctctggggtctactcgctagatgccaatagcacaatcgcccgtcccgcccctgcccccaccccccgcccccgccagatccctccaagtcgtgacaacaaaggaaagcgtctccagacattaccaaatgtcccttgctggggcacaattgcctctggttaggaaccactggcctaacataatagccacatttaaaagagggaaagacgaccttgaaaatgttagacctgtcttcttcccctttctctagtttctaaagcatcagaaaaactgttgaaagacctgcaaaggggcaaaatagagaacaagcaacatgtttcatgttgaattctcttccgtggaagagcattgtgtctgccaaaggataagatagccaacatttttttaagttaaaaatcacacagttaaaaatgttttgatagaaaagttagaatagagatcagccaaaatatacatatgcagaatctcctgtaatcctactgccgagataaccatggttcatattttggtctatttccttctaaccttttccagcatgcgtatacaagtatatattaaaaaaataattttccaaatagagccataccaaaagctgttataaacagctttttaatttaaatgtgccacaaatacctttccatatctatgatacagagttactaaggtttgtagtattttgttgtatggctagcatatagtttattcacttagtctcctgttgtgtacgtttggtttgcttctaattttgtttttgctgttaacatgcaaaaccgtggtgagtatccatgtgcatacttacaccctttccagcttattttttttccttctagaagttaccatcactgtaatttttagtatccattgagtaagatattgaattcatagtgttctggattgtattttaattatgtcacatacctttacccctcaaaattacggaaatgtattgattaaaaatgtgtttatgtgctagacttgcagaatggggtgtggaaagttctttggttttctgattgaacgatgactaataagaaaccatttgggtttcgtgccttgttcatgaagcccagtcttaactgtgtcaggctacttcctgagtaggaatcagcccagtgaaggttgcttaaccgtcctttaagattctgttcactactgaaagaaattcaaggctatatgctcgtgaattctcattgctcatggatttttcttctatgtgttttaaattataaactcacggaaaagacattcagatggtagagaagagcataaagtttcctactttactcccctccctcttggtttttttttttttttcattctctaggatttttgtatgcttgtacaaatattgaaatacaaaaaaatttaaaacccacaaattgggcaacagaatgcaatgtgtgagccaagtagcttttttctacttaatgcatctttctatatcagcaccttattctgtttaattggtgccctatttggggttgttttcagcttctcctgcaacaagtcaccttctattatgagtctatccataggatacatgcttagcagtggagttgttgggttaagagtttatgtccttatggttttgatagatattgctaaattgcccttctaccagcaatatatagcttgacttgtttctatcaggcatttttttcatgcctggcataaattattgattaataagctgggaacacaaaggtagaatctcatctataggaaggagcatagttggttaggagaccatgtcttccctaatgaccattatgagtattggttttcagccttgagcatactcagggggatgtgtatttactggtttcctcctggggttggcctgaaactggcttttacttttttcaaccacagagttagaatatgcatataaagttgggagacaatacccagatagacaactttctgggagtattcgatgacatgcctcaattagaattgaggtggttagaaatggacccttattactaaagaggttgtgacatgtaaatatcagtgggtctctgaaatagaagcataggtcatttggcatttggtacactgtatcaaatggaacataatataataaatgtaaatgtaacatgttataatcatgttacagtcattactacccctcttatctcttccatgacgtcttttctgatgtttcttcattccccatcttctcccactccaagatgactttttttcacactgtccttaaaaaaaatatagctggtactgcatttagggctttaaattgttttattatcttggatcagatatgtatccctaatcaaattttaaccaacacttggtttctggtcctcttcactctggctgggtgtttggaacgtaagtattttgattggttgtccactctagaattcttctgatttcatggggtccctgtgcttggtaaaggagggctctctcctggacatctcccccttgtaggcccccagaacggtgctcataaaggactctgtcatctcagtcttcagagcactgctttcctgcctagggaagggcacagcagggtgccatcttttatatgatttggtatctgaaggagcagaggatggtagatgtttgaagatgattctgtgaaccctggtgggtacggcagctgccagagcccaggtaaccatgtgaagggctcatattttctgaaaagtcagggctttctgatgggcactttttagggtattcttggccaggatttttttttttttttttgagtcggcctgaagtgtcctggaaggtggaagctaaaatccatgtaggtttggcctcaggctgggcctcttagaggaggtggggcagctttcatttcctttctccttgagccccgagggctgacactgtgccctggggactctccctggcctttcccaggggatgacctcgagagagtcttaaaaagggaacaaaccaaaaagctgttatttatttttcttattgttcagataatatattttcctttatagcaaatgaagagggcttttagggggcaggcagtgtgatctgaggaaaatggcctctggggtcaaatagttctgggttggaatgtgggctctgtggctttttccctaaggggctattatgggccaaattttgtccctaacccccctgtacctcataatgtgactgtctttggagataggtcctttaaagaggtgattaagttaaaatgaggccattagggtaggccttaatccaatctgactggtgtcctcataagaagaggagattagggctcaccgagagataccagggacgcagacgcacagaggaaagaccatgtgaggacacagcaagcaggtggctatctgcaagccaaggagaggggccccaggagaaacccaatgtaccttgattccagccttcagagctgtgaggtaatgaatttctattatttaagcccccctagtctgtggtattttgttatggcaacctaggctgactaagatgggggcttttagcaagtcaggtcccctgattttgctttcctaaagagggaccacaacaccctgagttgacaagaagagtggacacagtgcctggcttctaggaggtactttcaaatggcagtggtggtggtcaccataatcatttaataatatgataatagaaatcaccacccccttccctcacccaagttttctgaccccgtctggtttgaggtttttctttttctttctttatttttatttttatatatttttttgagatggagccttgctgtatcacccaggctagagtgcagtggcgcaatctcagctcaccacaacctctgcctctcaggttcaagcaattctcctgcctcagcctcctgagtagctgggactacaggcatgcgccaccatgcccggctaatttttgtactttcagtagagacctgattttgccatgttggccaggatggcctcaaactcctgacctcgtgatccgcccgcctaggcctcccaaagtgctgggattacaggcgtgagccaccgtgcctggcctctttttatttttttatttttttaactttccttttaagtccttttcaaagagggttgcaaagaactcatgtgatcagagattggtactttataggttgagtgaagtattttcttttgagtaacccttttcatccttttcatctgttaacatattggaggtccaggtaaaattgtatttaggacaaggattctgctgccaaaatagattcaaagtgactttcagcgtggtgtgaatatttactgtacctgacacccattgtattagtttgcttgtgctgctgtgacaaagtaccacatgctgtgagtggcttaaccagtggaaatttattgtctggcagttctggaggctggaattcagagatcaaggtgtgggcagggttggttccttctgagggtcgtgagggagagtctgctcctccccttgcttctggtggtttgctggcgatctttgggttgtagacacatcaccccagtctctgtcttcatcttcacatggcattctccctgtgtgcatatctctgtgtccaaagttcttcatttttgtgttttttttttttgttttttttttttttttggagatagaatcttgctctgttgctcaggctggagtgcactggcacgattatggctcactgcagcctccatcttctgggctcaagtgatcctcccaccttggcctcccaaagcgctgagattacaggcgtgagccacagctcccatcccaaagttctcctttttataaggataccactcatattggattagcgccactcaaatgacctaattttaacttgatcatctgcaaagaccctatgtctaaataacgtcatattcatggatactggggataaggacttccatatcttttggggagatacaattcaactcataacaccaattatattggaaccctatttgccatctgtgcacctctgcctgcgtccggcagcttctcaggagaagtccctctgcctggtctgccattcttgtttgccatgcagatttcagcgaagaagtcacctgctggagaggccttccctggccaccctcaatatagagtgattgaatgagtgaaatagattgcagagtaaaattaaaatgtgattgagaattatgctgagcataatttacccttaaaagtgtgagagaactcctctccaccccacatcaatgttacttgtaacttttttgtatatgttggctgtgtccccatcacagatgctatttaaatatcattttgtgcctgtgaattgagatgtcgggcaccttctgaatgtcatgatgtttcctattctgtgtgcagagcatgccaagaggattcaatttgttgaatttggatctttttttgcaatgagtcactatttgattatgattttacaacaattcacagaatcaaactggctagaccccttctctgaaggacatcttgggtccagaaaacctgtgaatcatgaataagggaaacatttactaatgctagttaattatcagtgtttgttaaatatgttctccttgctgaaactgctaggggctgtgcagaataccgaaatagaataggcaatagctgtggcctccaggaacacacaattcacatcaaacagccaaaaaatagataatacatgcaaagtggtgtgagaaggtgtagtacagaaattaagaagaagtgcttgttgtggaccagaaagatcaaggcaggctttgctgaggaacttagttaggcttgggctgtgccttaaagagttagagatcccaggagaggagggagaataccagctcaagacaatattaacataatatcattaagctgtataatagtcacagtatatattgaactaccaggttttaataaaaattttcttcacaagatagatatgaaatgatttgtaacagaaaaatattgtatacatcctaaatgtccatcaacttgggatatataagttatagtacatccatatagtagaatactctacagtcagaaaaaagaatgaggatgctttttaccgctgtggaccttccaaatatattattgttcagtgagaaaagcaaggtgcaggacagtgggtatgatatgctaatgtatgatattttcttaaagaaactagaagttgcctaagaaactaataacctatgtgtggtagtggtagactgggagaatgggagctagattctgtgtggggatgtttgtgtgtatgtgtgtgatttgaatgatgtaaatgtatcctattcaaaaagttaggtgtgaagacaatagtatttggtcacactgttgctacccttaaattgacttagtgctttgccttgctgggacataataaacgaagataattagtgacaccagatatcttagagataaacttttgcatttgcccagagaatgaaattcccttgaccagctttcacttttgttggccgccacaagaaaggtttgaagcatagcactcaatagaggggctggtctaatgaacccctttttacccatcgtctagcttcagcgttatcatctgctggccaatgctgctttgtttgttctctctcctcctcattcttcccttcttccctggccttgattattttgaaggcaatgccattctgatggaataatttagaattattactctgacctcctgagtcccaccatggccccagacatgcagagtacattagatgcttaggtgggaaaagctgtctttaatggaatttggctcatcacattaaactcatttgattttacttaaaaaaatgtaaaaaattattgtgcaatacaggtaacataaaatgtaccatcttagtcatttgaagtgtatggttcaaatagcactaagtacatgcacattgttgtgccactaatcttcagaacttttttatcttgcaaaactgaaactctgcacccatgacacaccagctccccatttccccttccccccagcccctggcaaccaccattctgtgttctgtgtctgaatttgactcctccaagtagttcatgtaagtggaatcatatatgatttgtctttttgtgactggcttattctacttagcataatgtcctcaaggttcatccgtgtggtagcatgtgacaggatttccttcctttgtaaggctgaatcatatcctcttgtatggatataccacattttgtttttccattcagtcattgatagatacttgggctaactttactttttgccccctcttagaatataaggttttatggctcataataatttcatgctgtagcacatcagaatgcctcagcacactattaccctccagttaagagaataattctgagcagtttgagaatatatgtatttttgagacagggtctcactctgtagcccaggttggagtgcagtggcgcaatcttggctcactgcaatctccgcctctctggctcaagtgatgctcccacctcagcctcccaagtagctgggaccacaggtacgtaccaccacgcctagctaatttttttttttttttgtattttttgtagagaccgggtttcaccatgttgcctaggttggtctccaactcctgggctcaagcagtccgctcacctcatcctccaaaagtgcttgagaattcttataccaaatactttgacttgaaaaaccagcaaattttcctttctgcttttgtgaccaagggcagcattttctctcaaagctcttacattgaattttgtctctcaccagactagattatgaatttagagagactagggcagggggtggggtgatatcttcatttgcccagtacctggcactgtgcttggcactgggtggatactgtgtatgtatttgttggaggaggagtgttactttgggcaaggcatgtacctatacctttataattaggaagttgaaccagatgaattctaagaccccttttggttctaacattgtttgggtccatcattaaacctgaaaatcccaggctgggcgcggtggctcacacctgtaatcccagcactttgggaggccgaggtgagcagatcgcttgaggtcaggagtttgagaccagcctggcccacgtggtgaaaccccatccatctctactaaaaatataaaaattagtcaggtgtggtatgcctgtaatcccagctacttgggaggctgaggcaggagaatcacttgaacccaggaggtagaggttgcagtgagctgagatcgcgccactgcactgcagcctgggcgacagagtgagactctgtctaaaaaagtaaaataaaataaaataaaaaataaatctgatgatgaaaatttcagactctctggaatactggagatttgggggaggtagtgaaatttttggatagacatattttcactgcccctcaaatgatacccagaggtggtcacctacaagtaaacccatgtcaggatatagtgtttcttaaaataacattctggatttgggacttcctctttgtgcagtgggtgccattctttgaataataaaaaagctaccatctaaaaagtgattttaagtttagcttaatcgtgtaccacatttcctagatatacacggatagaaaacaaacctcctcttgacataatcatctttataatgaatctcatcggaagtcttaatggtaatcttaccatgagaagaagtcaaagcaatgagcaactgaggaaaatgaaaattctggaattagagaaaaaaatgctgataagaaaggacagatgtgatctgagtactgaatcttgttgattttctgaactttatgctcatttgtacatttttattttaagcctggtttccaaaagtctcttgttagcaaccagatggtcgtcaaataattgatacgggttcattttaagcccatttgaggaacataatggcctgaattttccagtagcagggtttagtaattctgctggtctttgaatgccaacagggttttttggaaattgagttccctaatgtcttggaagtaactcttggaaaataggaaccagtgaattgattgcatgatgtacttggaataaaaagttaaggatatggtttattttggctaaaacgtccacccttagaagtggttaaatttgtaaaattaggtgaggatttttgtgtgtgtgtttaagtttttttttatttgttttctgaggcttgagttaatgaatatgaatagacatttcgaatacactaatctgatatttcccattttcagagatccgttcaaactctagggtctgtgcacgtttttacttacatctgggagctaaaaagtctgagctcagaaacagagtagaattatggttataagaggttgggaagggtacagagagaggagggtagggagaggttgattaagggatacagaattacagctagatgggaggaataagttctagtattctgtggcatcataggctgactataaacaacagtttattgtatattttcaaacagctagaagagaggatttcaaatgtttcaagcacgaacaaatgctcagtgtttgaggtgatggatatgctaattctgatttgatcattatacattgtatatatgtattgaaatagcacatgtaccccataaatatgtacaattattatgtgtcaattaaacaaaacactggggtttgctattctaaagtcttactaaatgcttttcaaagaaagaaaaactccttaaagtgtggtttgcaacgagaaaaagggttgtgagctgcctccagagtcagtgagactcaatggtcattttgttattgtttttgagacagggtctcgctctgtcacctaggctggagagtgcagtggcatgatcacaggtcactgcaacctcgacctcttgggctcaagtgattctcccaccccaaccacctgagtagctgcacagtgcctgtgcacgcgccaccacgctggctgatttttgttgttgttttttttctcttggtagacagggtttcgccatgttgcccaggctggtcttgcactctgggctcaagagatcctcccaccttgtcctctcgaagtgctgggattacaggcatgagccaccgcacctgacctgttatttgaactggagaaaggcatcagcaactgttttgggggtgctagtgagccgcaggttgtattgctggaaacagtgaaagagagagctgaggtctgtctgaaaagcctcatgaactgtcagagcggtgacagagcagctgtgctatggagaggtactcctttcaagtgctcttttagttggtattctcagaatgtcactaggtgtttccagcagaatcccatcttgcgaaacgtgtctgtcctgggctctctgttttggtgtgtgcgtacaaagccttcctttcctctcctctgctcacgccaccatggctagccagtctctggctgtcttgggatctgagtggagctcctggtggaaccagacccagaggcctcattggtggacaggttagttttccttggctaccacaacaaatgaccacaaactgggtggcttaaaacaacagaaatttattctctctgatttctggaagccagaagtccagaatcaatgtgccctccaacggtgttctaggggagaagccatttcttgcctctcccagcttctggtggctcctggctttcctttgcttccagccgcatcactcctctctctgccttcctcttcacattgccttctcctctgtccatcttctcctctgtgtgtctcatatgaggacaacacttgtcattggatttagggacccccaggataatccagaatgatctcttcatctcaggatccttaactacatcagcaaggaccctttccccaaataagatcctgattctgggaattagaatgttgacatatctttttagggggttgccattcaatttaccacagtaggagtagcaattcaggatggggccttgaaaaggaagcagaagaaacagaagccttcataatgtgatagtttaaaaaatctgcctggtcatttaaaaaaatccttcagaaagtaactttattgaggcacattttaaatatcatgtaattcacccatttcaagaatatagctcaatggtttttagtaaacatacccagttatgcaaccatcatcataaaatgctttagaacattttcatcaccccaataacatccacatccttcatgcccatttattgttaattcccattcccactcccagcttcactgcctgctgtctgctgtctctctagatctgccttttctggatgtttcatatgagttgtttttttttttttgtgaccgagtcccactctgtcacccagactagagtacagtggtacaatcatggctcactgcagtctcgacctcctgggctcaagtgatcctcccacctcagccttctgagcagctgggaccacaggtgcatgccactatgcttggctaatttgttgttgttgttgtttagacgggtttcactatgttgcctaggctggtctagaactcttgtacttaagcgatcctcccaccttggcctcccaaagtgctgagattgcagacatgagccaccatgcttggcctaaagttttatttaaaacttaagaaaacatttctgattgtaaaatatggagaaggacaatcccatcacctggagcctgttagaaatgcagaatctgcagtttagcaagatccccaaggcattctctatattagacttagacatactggtacattgtatctgctatattgatcccttgtccacttaatatattatgagcacttccccaaaagtattatatctcttctgagaacattttaaatctcattgtaagaatataccacaatctatttaactagccacttcatggcagacattgtttcccatctttttttgcccttgaaaataaagctgcaataattatctttgtatagaaatatttgtgtatagttttatatctactgtatcagtaattccatttctaggaattgattataagacaataattatagacagactgctaaaatttagaaagtgcatatgtaaatactgatcagtggagtcagtcatttaaagtgctgttttccagcatggtactggtaccaaaacagagatatagatcaatggaacagaacagagccctcagaaataacgccgcatgtctacaactatctgatctttgacaaacctgagaaaaacaagcaatggggaaaggattccctatttaataaatggtgctgggaaaactggctagccatatgtggaaagctgaaaccggatcccttccttacaccttatacaaaaatcaattcaagatggattaaagacttaaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacaacaggtgctggagaagatgtggagaaataggaacacttttacactgttggtgggactgtaaactagttcaactattgtggaagtcagtgtggcgattcctcagggatctagaactggaaataccatcccattactgggtatatacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtcaactattgtaagaacaaaaaaccaaacactgcatattctcactcataggtgggaattgaacaatgagatcacatggacacaggaaggggaatatcacactctggggcctgttgtggggtggggggaggggggagggatagcattgggagatatacctaatgctagatgacgagttagtgggtgcagcgcaccagcatggcacatgtatacatatgtaactagcctgcacaatgtgcacatgtaccctaaaacttaaagtataataaaaaaaaaataaagtgctgttttcctggaaactagacctaaagccaagcagataataggaaatgtgaacccccaatacatgatgttagcacatcttgctaactctcacctccttctcctcctccttttttttttttttttgagacagggtcttgctgtctcacccaggctggagtgcagaggtataatcatggctcactgcagccttgacctcctggggtcaagcaatcctcccacctcagcttcccaagtagctgggactacaggtgcacactatcacacctggctaccttaatttcttttctttatagagacagggttttgtcatattgtccagtctggtctcaaactcctgggctcaagtgatctgcccacctcgccctcccaaaaggttgggattacaggtgtgagccactgcacccagccacctccatctgcttgagcattggtttcattgttgaacaaaatgaatgagcaaataatgaatgaatgagtgaatgacaatggcatcaaaaagtgaagtgtaggttgttactgagcagcggtgaaatagaaaggaacaaaatgctggacccacatgtaatcactttcttatctgttgtaattttatccttactcaatttccaacctccactagtcggttctgcccttgtaaagcagcccaatgtgtcactcctggaagcccctgctgcttcaactatctgtagcacactactcctcataggtggaaagtcagtcatgggagtgacgataccttcctcagatcacacctactggcctttcgattccgttttcccacttttcacaaggattgtagtctcttgaatatttactggccttcctagttctcagatccttgggaagtatgtgaagaggtcgggacttgtgtattcacttcgtatctgcccgattgccaggctccttaggtcaaggaggaattgagtgagttccaaggagagggtaagtctgaattttcccctttttttcttttctttttttttttttttttgagatggagtcttgctctgtctcccaggctagagtgcagttgcacaatttcggctcactgtaacctcagcctcctgggttcaagcaattctcctgcctcagcctcccaagtagctgggattacaggcgcccgccatcgtgtccagctaatttttgtatttttagtagagacagggtttcaccatcttggccaggctggtctcgaactcctgacctcgtgatccacccgccttggcctcccaaagtgctgggattacaggtgtgagccaccgcacccggccgaattttcccctttcattttctgcactgctgtgttctctgagctttccactgctatagtgtttcctgatgagaaggaagtgtttcctccagcttttttttcttcctggaggagtaggatatgaaggaatccctgcccccacacggggtgggatccagccagctgctccagaggatctcggcccctcctgtagcctcaaccttttttgtttctctgggtggtgactctcacaccagagcatacgttagaacctcctggagggcttgctcaaacaccgactgctggaccccaccccatgccttctagttcaatagtctgggctggggccagagagtctgcatttctaacaggttctctggtgatgctgctggtgtggaactccactttgagaactactgctctggcccacccctcattgcccctcttcccctgcaattgcttccaagtaggcagaataaggcgctggaggactggtgtgtttgagacccttgcatctagggagcccgtccagacttctaggggtagcgcctagcagtggtgtgtgcctgttccaccaatgaatgcagctttagacaggcccttcagagtataagaagcagtggctcattcaaattccttcaagtagtgggggtgagaactagggggttaaaaacagagccccaggtccttaaggcttcacaggaactcatccagaaagccagcaggtatgggcaggctggggcctcagcctgccacatgcctttgtgtttcagctggcccaaggctgtactgaacattataacctttcagccctggccctttctgttgacttcctctcctctcctcttggtgggattttcccctgtatttagggcagggcagtttcttctggaaggatccctttggctccaggctctgtgtctaaccctcccacttgaccctgtagcacacagccctggccagttgctggtggaagctgcagtccttagtgaaatggggagtggactgtggttcctcaaattgcattgtcatttggaggctcaagggcataccttttttatcctcaaaggcttaaagacaactgatggcagctggagagggttaagggagatggaggaaatcttcattcaagtttgtcttgctcagtgatcttttaatgtgtctttccagtcttggggtggttgtgtggtctttcagtacagattcaggtggcaggcggttggtggtttggtttaaatcagaggtatgttaaaatattcaggatggtgagggtgtctgtgaaaactaagagaggaagtggcttaaagagctaggctgtcagctgggtgcagtggctcacacctgtcatcctggtgctttgggaggctgaggcaggaggatcacttgaggccaggagtttgagaccatcctgggaaacgtagcaagaccttgtctctacaaaaaattaaaaagaaaaaattagctggacatggtggtgtgcgcttgtggtcccagttactcagtaggctgaggtgggaggatcacttgagcccaggagtttgagattacaatgagttatgatcatgccactgaattccagctttggtgacagagtgagaccctgtctctctctaaaaaaaaaaaaaaaaaaaaaaaaaaaaccaggttgtcaagctagatttagaattctttttttaaaaaaaattcttttattttttccatgggattctgcttgatatagacttaattctgttgtctgttggcccagggacatcactgcccagtggatacctcatccactcccactctttttgagggttttctccagggagttgaatctgtgaggcagtctttccctcctgctttcatttctcccccagcatcttctcttaggccctgctaggccacttgagcaagaatctcaggccataaaacatttccacatcagatttcctccaacagcacagggcgcttatggctcacatgtggaagcgtggacattgacatgttattttgagacttctgactttagagcattttgaggaaagtatcttctgaggtctttctttcctgtaagctagctgtagtagccaattccttttgggggatgggggaatgaattcttggcacactctgttgtcctttgggctagtcacatttgtgctaaatatcaggcgagctccctgcggacaccatgggatgaggacaacatcttattcttggcaatttgcaagggacaaattaggctgtggtacttgcaagtagaattattaaatatcaatgggggataataaatgtgaagtagcttgcaaatcttctgatattatggctgtttcagtgaaaacacagctgctaagatactttcctagctgtaatcgagaaggtaattttcctgaaaggccatttaaagcagatctttagtgcctttggctcattaagaagcatgaataggggtaagtctctgaaaaagatgaattagacacagagcagaggagcggtggtgtccatgatgcaggatgatggtgtccagggcctgcgtactccaaatagaccaaggactaattagttgtgtggtttattaatggactggagtcaatcctggactaatacaactaattcttccatttagagttaatgttggcactcaattttccctggtaatgagtgagttagagtaagcaggcacgtgagtgtaagatacagtgctaatattttgtgagaaacattgaacgaggcttgatgtttaaatcaatagttgaaaatgtgggggaagactttccagaaaaggcttacaggctaaataagagcagttaattgaaagcaaaccaagcccacccaatatttagatttgtttagaaaccaagtgaacatttgagatgagaaacatttctctagttctgtgatgtcgtcggctttcctggtgtgtttggagcttttgacattggtgtggtactttacctcagtgaggctgatggaacagagtggatgttacagggcctcaatttcagaattcttgttgtgtactcgtgaagacctgtggagagattttgcctcaagtcagtttggatggtttctgccctccagtctgataaagtcccctgatgtcaaaccacaggtggaatttccagagactgtgatctgtggactggtgacaaatcctttgtgaaaagtctgtgtgacactactaaacagagagggcttgggggaggagaatgaggggaccaatgcgctcccctcagaagccttgatgctctcatagaaggtctggccaggtgtgggggtctagctttgtaaagtaggaagacccctttgatgattactttttttgtctagttaaacctttttggatttctctgtaatttaaagaatataatttttaaaatgtaaagctgaggattcatttttctatgtgttaataaagttaataaaccccccatatttattggggaaggcagtataaactagaatttccttaggtttcttctttctttctttctttctttctttctttctttctttctttctttctttctttctttttttttgagacaggggagtgcagtggcgtgaactcggctcactgtaagctccgcctcctgggttcacgccattctcctgcctcagcctcctgagtagctgggactcctggcgcctgccaccacgcctggctaattttttgtatttttagtagagacggggtttcaccgtgttagccaggatggtctcgatctcctgacctcgtgatccgcccgcctcagcctcccaaagtgctgggattaaaggtgtgagccaccgcgcccggcggcttaggtttcttaaaagttaaccaagtgagcatcactgaagattaaccaaaggatctatgcaaagatgtatttttattttgctcaaacagttgtttataaaaggtaagatgaaaaccaaagcacacattacagagtaggaaatcaagtacttttatttcataccagaaataggaggaaaaggataaaatcagggtgaagccctaaaaaaaagacagtcaaaaaagaccctataggagggctgggagagtttttgagccatgaggaccatttgaccttggtgacagggcagctactgagttcccagaattctgccttttcaagccatgtaacatttgcaaatgctgacaaacagctgctaattccgttttctatgaaagggtgacagggtgttctcaggacatgagcttcttctccccagagccacatgcctttcacacagtgacagtggcaccatcagtgaggacctgggaaggagacaccagtccagaaaaatgatgattcttttttttttttttttttttttttttttttcgagccggagtctcgctctgtcgcccaggctggggtgcagtggtgagatcttggctcactgcaagctccgcctcccgggttcacgccattctcctgcctcagcctcccaagtagctgggactacaggcgcccaccatcacgcctggctaattttttgtatttttagtagagatggggtttcactgtgttagccaggatgatctcagtctcctgaccttgtgatccgcctgtctcagcctcccaaagtgttgggatgacaggcgtgagccgctgcgcctggctgaaaatgatgattcttataggggggtgtgtgtgtgtctgtgtgtgcatgcacgtgtgtgtgtgtgtgtgtgtgtgtgtgtttgtgtgtgtgagagagagagagagacagagactgaattgcttgagaaaatttgcatttgagttcagaagtatgagcccacatctgtgaaagcagtaggtaagagactagtgaatgcagatgactcagatatgcacacaaacctgtggatttacggttttagaaaatacaaatatacattgtgctaaatttgaataatttgaagtgaggtacaattccaaagagcaagttgtgatctaggacaaaggaacctctgggatgagtgacagctcggagagccagaggtggaaggaggaatgaaacacagctactaaggctacctgtgtcatgggccaccctggaggctgggagatctcttcttatgggtttctctcctatttgtgtctgtgtgcctatctgtattctctatgtgagtctctatgcttgtgcatcagtgtctctgtgtatgggggttctgtttttctgtgtctatgggtctgcctctcccactcgctgtaaacgggctaccccagaaacacttgccagatggagcacactggcctgggtcaatgccacatatggtttcttacaagttgcagaaaggttacacttagcaaaaatgggtgtgccccaaagccccacacagtgaacaggttttctcatgatcttgtcacacctgtcacaagagtgggggaagatgaggaggaagagccagctggaagttttagaatcgtgtttaatttgtggtttacatcctcctcccgacccttttccctgacaaaccacccacacacttttcactttgcattacatttgtcctcgcccatctccatgggatattcctagaattctgaatgcttcctttgactttctctactgcagaaactcttctccctgggaatgatttttacagctccagttaattttcatgttcaatgttggaacggagaggaaatggggggagcatgggtggtgactcaggaagctgaggaaatcgcccttattaggcctcgaattttcttctaaaaaaaaacaaaaaacaaaaactggccccaggctgtttgggccttatttttttctgattgctagctttcatttgacctccctccttccatttctttctctctttggttctgctttgaaggtcacaaagcttcccaaagctgttaaaggtggtgctaactccctttactgaaagattactcttcagctgtaccagtggatttcccctaacagcgctcccagaagatgaacagactctcttattgttggtaataactgagtttttaaagaggacaccatcattggcaataatttaaatgacttttctaaggtattttcccaactgtttttctctttttcctcttccacttgagcaaatgtcatgaatttccttttttttaaaccaccaacacaagtattttttttcttaaataatgtgtatacttaaaatttgtaaaatgcaggcaggaaccagaaagataattcattttctagccagtcgtttgttgtaagcctgatatgtgtttgttatttttctacaaaaatggaatcatatggtaggtggtgttttataagaagtttttttttttgttttaattgtggtgaaatacacaacagaaaattgtaaccaattttttttttttttttttgagacggagtttcgcttttgtcgcccaggcaggagtgccatggcagaatctcagctcactgcaacctttgcctcctgggttcaagcaattctcctgcctcagcctcctgagtagctgggattactggtgcgcaccaccatgcctggctaatttctgtagttttagtagagatgggatttcaccatgttggccaggctgatcttgaactcctggcctcaggcgatctgcccgctttggccccccaaagtgctggaattacaggcatgagccaccgtgcccagctgtaaccaatttttaagtgtaatactaagttacttaattttctacaacatcagtaatgtttttcaagttttttaaagttgcagaaccctttcctcaaagaccagagagcttcaagcagagctgcaccaccattgaggcaggagtggggagcccaggctatatcttgtcaatgttgcagtttacggttaccctccccatagctttgaggcctcctagggatcctggtcacactcagtagccaactttgaaagcacatagacctaccttatactgccccaattgttaatagcttagattgctctaattttcttataaagaaaaaattttggacatactttaaatcctctttgaagcacatctgtgattacttccctagataagtccttataagtagagttactgggtttagaatatgagcggtgttgttgtttttttctttttggcctataatccatattgccaactggtcttcaccaaagtgtgccacatcagactctcacagtaatgtaggagaaggctcaaccccccattccctgggtaaaataaaccttaaaaattcagtatgttagcaaaagaaattatcaacagggtaaacagacaacctacagaatgagagaaaatatttgcaaactattcacctgacaaaggtctaatattcagcacgtgtaaggaacttaaatttacaagaaaagccattaaaaagtgggcaaaggacatgaacagacactttttaaaagaagacctgcatgtgaccaacaagaatatgaaaaaaagctcaatatcgttgatcattagggaaatgcatatcaaaaccacagtgaggtaccatctcacaccagtcagaatggctattattaaaaagtaaaaaaaaaaaaaataacatgctggtaaggttacagagaaaagggaacacttatacactcttggtgggaatgtaaattagttcaaccactgtggaaagcagtgtggcaattcctcaaagagctaaaaacagaactaccattcgacccagcagtcccattactgggtatatacccgaaggaatataagtcattctaccataaagacacacgcacaagtatgttcattgccacactcttcacaatagcaaaaacatgaaatcagcctaaatgcccattagtgatagattggataaagaaaatatggtatatatacaccatggaatactatgcagccataaaaaagaatgagatcatgtcttttgtgggaacacggatggagctggaggccattatccttagcagactaacacaggaacagaaaaccaaataccgcatgttctcacttataagtgggagctaaaggatgagaacacatggacacaagggaacagacatgggggcctacttaagggtagagggtggaaggagggagaagagcagaaaaaataactattgagtactaggcttggtacctggatgacgaaataatctgtacaacaaaccctcatgacactagtttacctatataacaaacctgcacttagtgacattattttcgtatgtctgttggccatatatggttcttctttgaactatttattcataacctttgcccatttttagattcagatgtttgtccatgaatccgagagtgagaacccttggttatactgtgtgtagacattttaagcgatattttcaagaatcagctgtgacacaaaaggagtgggggattgtgggccaaaagtcttacagtcagagtttagcatgagaacttggaaagaataaacttctggactttgatctctgattttatgattctgtgatactagatgacttatctgccatttaggaaggttctgtcatattgactagagagaaaatccggagttaaaaccaatggctgcattaagttagattttttttagcagtctgattaatctttactgctccagtactcaaactgcaacgtgagagttcaatcttgtggcttattacaaccacacattgtattaaacatcttctacttgagaaaaacatgaagtgccccatgtgcattttgagtatgttatatcatgagtaaagtcatggctggaaggtagttaagacagaatttctttttgtttgtttggcaagtgatgctaaatcaacaataatattgctttgaaaaggagcaaaattatgccatgactatttgcaatgaaaataaattataaggcctggtgtggtggctcacacctgtaatcccagcactttgggaggccaaactgggtggattgcttgagtccaggagttcaagaccagcctgggcaacttggcgagaccctgtctctacgaaaaaaaaagaaaaagaagaaaaagacaaaaattagccgggcatggtggtgcatgcctgtagtcccagctactcagaaggctgagatgggaggactgcttgagcctgggaggtggaggttgcagtgagctgagatcgagccactgctctgtactctagcctgagtgacagagctagaccctgtctcaaaaaaaaaaaaaaaaaaaaaattataacgcagctgtataataatattgctcaatatgctattataaagtgaaaacctccttctgcttaacaggaggtgtctctatttcaggacaggacactttacatggaataagaacaaagatcttactaatttaaaaaaaaaaacccaaatgtgtgtgtgtgtgtacactgaatttggccagacaggaaaacaagattaaaatgtcagttctgtcttttcaacctgaatgcctccaacagctacattttagaaatttctgaaataattaatgtgtactcatatgttcacccataaatcagaccatgggattactgatgaaaggatgcaaacttgggggtcagtcttggaaaattttgactgaattttaatcttcctattgtgaacatctatttcatgttgaaaactcagcatttcctgtttctcctaaacatagacaccacaataaatagtttgtatctatttcttttccttcaaaaagatcacagttctttgcctgtattatctagctccaagataaattaaatgccagctgaaattgtttggtgtatctaggatgcccatggtatgtgccatttggttgtgtggctgagtcagtggcgttaggtggagtttagcctccccctgagtggttattagggttgtggatggaatgtattgaattcaaatctctcatttataaggcgaggtgtgaattgtagaatgatccgattaacttgggctgaaccccagatattgctgtgtgctttttttcccccttcaacatgtcatggaggcttaaaacagtcacccacacgccctttccatatttaaccttttggaggtgctgtcttattgctgagccagggtggtaatagctgactggcttaaatggacagacagcaacaagatagctgaggagggtaatagatcctgccattctgttcatctgcgtttgtgtctgggtaaaattctcattaagttgcagccagtgtgtgtattttgtgtgtctgtgcattgtgtttgcagtccattagaaaactgatacccatgtggtgccttggtattgacaggtttcctgtgtgtgacctaaaaccattctgcattttcatttgtcaggttttcccgtgtgctctgggttcagagcaaattaacttccaagtcaacagaaccaccgaagttctgcttgaactaaagctaagctactctactggtgtggggggagggaggatgttgatcattagaggacaagggcaagttgagaaattgttctatatttcagccagttaattatcgcagcttcccagcatgtctgcaaggagaaatgagaagaacatcaataagtgattattttctttcattattctgttcacctgccatttactgtgcacgttccaggggaagggagattagcaggggttaactttaaaaaatcagagtcccagaggactcacaaaggcatgctgtgtctgcctttctggtactgagtgatgagggtgggacagggctggtgctaaacttttggatctatttttaagctttcaggacaaattttataaatacgagctgcttctttaaaaaaaaatccctttctactctaaaaatagtttgctgggaaaaagtttgtgaattgtttattaagactcagaaattcagctgagcatgtttccttataaataaagaaaatcacctcacagctactgtcaaaaagcagatgtggcttcttaggaaagaaacaagatttctgggatgttaatgccaatgtcagaatgtgggagaaaatttggaattttccctcctggcttgctcttttcagaccttctaaattctactcatttcttatgatcaagttggtgtcttgtcccttttggaaagagttttcccaggcagaatgaatggccttagcttctgttcttaccagtacccttagccacacctgtctcttttcctataacactttgttttatgttaatgacaattgctaatatttactgtatgccaggcactgttctaagctcagttcatgtgctattttattttgttgtcataactctttgaattagatactactattctcattttaaggataaggactatggtaggcagaataatggcccctcaaaggtgtccacgttctaatcttcagaacctgtgagtgtttaccttacgatgcagatatggttaaggattttggattagaatcacaagggtccttataagagggaagcacatgggcaacaaaagcaaaaatacataaattagacaacatcaaaatgtaaaacttccgtacatcaaaagatacaatcggaccaggcgtggtggctcatgcctgtaatcccagcactttgggaggccgaggcgggtggatcacgaggtaaggaggtcgagaccatggtgaaaccccatctctactaaaaatacaaaaaattagccaggcctggtggcgggcacctgtagtcccagctactcgggaggctgaggcaggagaatggtgtaaactgggaggcggagcttgcggtgagccgagattgtgccactgcactccagcctgggcgacggagcaagactctgtctcaaaaaaaaaaaaaaaaaaaaaaaaaaaaaaaaaaaaaaagatgcaatcaacagactcaaagtgcaatctgaacaatggagaaaatattttcaaatcatatatctgataaggggttaatatccagaatctataaagaactcctacaactcaacaacaaaacaaataacccaattcaaaatgggcaagggacttgaatagacagttttccaaagaagacataccaatgaccaacaagcagatgaaaagatgctcaacatcactgaccatcagggaaatgcaaatcaaaatcacagtgagattgcacctcatacccattaggatggctgctataaaaaaagaaaaaacaacaagtgttggtgaggatgtggaacaattgaaacctttatatactgtcggtggggatgtaaaatggtgtagctaccataaaaaacaatgtggcagttccttgaacaattaaaaatagaattaccatatgatctagcaattttacttctgggtatatatccaaaagaattgaaagcagggtctcagagatattatacacccatgtgcacagtagtattcacagaaggcaaaaggtggaagcaacccaagtgtctatacaacagaatatcattctgcctcaaaagaaggaaattctgacacatgctacaatgcggttgaaccttgatacattatgctaagtgacagaagccagtcacaaaaggacaaatactgtatgacttaacctatatgaggtatctaaagtcaactttacagagacagaaaatggactgctggttgccaggagctggtgggaggggagaaaggagttgtttaatgggtacagagcttctttttcagttttgcaagaggaaaagaaatctgatgatcttttgcacaatgtgactgtacttaacactactgaactgtgtagtttaaacctgttaagatgttaaattttatgtaacgtgtatttaccacaattaaaaaaaattttttttaaaaagggaggcagtaagatcagagttagtgatgatagaagcagaggtcagagagagagcgagcattgaagatgctatactgctggcctcgaagatggaggaagggaatacaagctaaggaatgcaggtaacccctagaggctggaaagggtgggagaacctcctctcctacagcccctgaatgaatgcagcctgccaacacctccattttagcccagtaagacagtttctggatttctaacctccagaactgtgagatactaactttgggttaagtcgccaagtttttggtaatctgttagagcagtggtaagaaactattactaaggactattcagttcagagaggttaggaccttgtgcatggtcacgaagtgactggaactctgattaagagctggagctggccaggcaggatggctcacacctgtaatcccagcactttggaaggccaaggtgggcggatcacttgaggtcaggagttggagaccagcctggccaacatggtgaaaccccgtctctacttaaaaaaaaaaaaaaaaaaaaaaaaaaaagaactgcaaaaattagctgggcatggtggcacagcctgtagttccagctattcaggaggctgaggcagaagaatcgcttgaacccgggaggcagaggttgctgtgagccaagatcgcaccactgcactccagcctggcaacagagcaagactcagtctaaaaaaaaaaaaaagagttggagcgcatgtccactccactcagagttccagccttcctagatggtgagaccctaggtagcagtggccatctttaacactacccccgacataggacttgatatatattaaggcacttagtaattgtggctaaaagatttaatgataatgcaccatcgccttttattctgttcccctgatgctgtgtcctagaagccatagggttaaacctaggaaaaggctttttagaaaacgtttcccttccctgtcattgtggggctgctaaggaatagtgtcctcaaggttttagtgtcacttctgggggcctctgggtatttgttgccaggtcccatgatggagtagagtcaggagtgcttatagaatccagacaggggtcagagtcaggggaaatttggatcctgttcttggtagatgggcagtctgttttgagaagaaatgaccaaatttagtcatgacctgttaacctgtttattaacattatttctctttaagctaaataaacgcagatatttctaagcacaaatgaagaaatttctgtgttagctctgatcagtgggcatttcccactctgaaatgcttcctcacccccaaacctaagctttggaaaccaggctcctaaaatcagggccttgtaattccccatgtgagttattctaaattgggcttctgggtgtttctttttttgaagtggggagcaggtgggaaatgagaggccttctaataatgtgcattaacttttgccataaaattattagaaaaaatgggtattttgtactttttttttttttttttttttgagacagagtcttgctctgtcacccaggctggaatgcagtgggcaattgtagttcactgcaacctccacctcctgggctcaggtggtcctcctgcctcctgagtagctaggactacaggtgcatgccactgtgtccagctagtttttgtgttttttgtgtagacggggtttcaccatgttacccaggctggtctcgaactccgtacctcaagagatctgcccaccttggcctcccaaagtgctgggattacaggcatgagccaccgtgcccggcctactttgtacttttaaaataatctttgagtgggaaggcctttgcaatcatgtcacaaatctgaaagacctaagggaaaagattgattgattttactacatagaaattagagacttctgtatggacagagatagaattaatagaataaacagacaaatgacaaacaggtaaattctgcaacacatatgacagccccaggggcacttcttttatatacagagagctattagaaatgagagggaaaagcaggatgctatgtaggagaattgacaaaagacatgagtaagctcatcacagaaaaagacaagtggataacggtaagcatatggaaagctgttcaaccttattttttactaattaaagaaatgcaaattaaatatcatctcctgttatcagattggcaaaaatgaagacatttaaaaatagtatggggaaatcagctctcttccatgctattggtgggagtgtaattgataaattttttggaggccagttttttattatctgctaaaagtaaggatgcaccaagttgttgacccagaaatttcactctagggaatttgtccctcagttgcctttgtggtatatgtgcagagttatgggcacagtgatgctcaatgtagtgttgtttgtaatcgcagaggacttgagacaactgggtggtttcatgtgggttatagttctgtgagaagagaactatctcctacccagcaagattcaaataagttacccgtttaaccagccaaggatacagaaatttagaaaggagattgcctcaggcaggagcgtatgaggtatatataaaaggtatatcccagataccaatctccactcgcaggtttccagtggtctaaatggcaagggagattttgccagatctcagaaacagccaaagtttgctgtgccacaaatcttttttccatgagcatttcagaagagccaatgaggacaactgttgtgccttcatctgtggtatggtgacaaataacgcagctcacctgattcaccttgcctgctgcctagacagagccgatttatcaagacaggggaattgcagtggagaaagagtaattcctgcagagctggctgtgtgggagaccagagttttattattactcaaggaattggaatttttaaagataatttggcaggtagggcttgggaagtgggtagtgctgattcaggtcaggttggagatggaatcatagtgggggtcaaagttaggtttccttgctatcttatgttcctgggtgggatcgcacaactggttgagccagtttaccagtctggatggtgtcagctgatctagtagagggtctgcaaaatacctcaagcactgatcttaggttttacagtagtgatgttatccccaggagcaatttggggaggttcagactcttgccaggagctgcatgacccctaaactgtaatttctaatcttgcagctaatttcttagccctccaaaggcatactggtccccaggcaagaagagggtcttttctggaaagggctattatcaattttgttttacagtcaaaccgtaaactaaattcttttccaaggttagttcggcctacgcccaggaacgaacagggacagcttaaaggttagaagcaagatggagtcggttaggtctgatctctttcattgtcataatttcctcagttttaattttcgcaaaggcagtttcacttccgtgttccaaaatctactttcagacacaaccagactgtcccttttgatactggtctatcctacagttggattctgtgcagctatgaggaagaggggcaaagctctgatggagaagttgtctaagatgcattgttaagttgaagaaagcaagttgcagtatagcacacatagtaagagtccatttgtgtcctcttgttatgtattttttggaatgaacatgtatacctttaattattaatttttgagtggttacccacacacagttttgaaagtcatatgctgctaaaagatgtgtgagtacccagcagcctcttgtcccttctctttgtgtccttatattctaggaggcagtcgttcttcagttctagctgttgcttctactatttgctgctgtgcttctgaataatattcattgctgctctcttggtttgtcgattctagatatgatctcttaactatcatggtagttgaggacttcagcttttctctatatgcacatatctcaggttttgctttaatctatacttaatgttttcattaatgtagcaatgttgatattgaatattgaagcaagaatatactataattaacttacgtatatagctttatttctctctctccctcctttcctccctctctccccatctccctctctccctctctctcccccctccctccccactctctcccttctctctctatccctctctctctctgtccttccttcctcttcgtccctccctctctctctttctctctcccctacttcctctcttctctctctctctccctccctctctcaccaccatctccctctccctccctctctctcttccccccctccctcctccttgttttcttctcccccctcccctcccccctctctacctctctccttctccctctcctggaaaaacaccagagccttccaacctcctgttccactctgctgcccagctgtcagccaggaaattcccatcacacctccgccgcctcctctctctcattgactgtcctggatcttgcgtccttctctttcttgttttactcatttgacttgatggaatgcaccctccagtagccttctgagggagccagtgcacggcttcaagtaaattttttgaaacttcttcaaaaccaaccacactaggagttgcatactaaaaagtttttccttttagcattcaaccatcccttcttagcccctggcccatgtctgttggcaggtggggttctccctcctactgatggagccagagaatcctgggacccagaggctgtgccattattcacaagatcttatttaatcttcagaatggtttgataaactaacaaaactgaggcaccaaggttacgctctcagtggtatcagaaccaggaattgaagtgtcagctgcttgggccaggctgatgcctttcctaatctagctgctccttactggaagaaggaataacagtaccatgccccaagtgacacatgccagatgcatgtaaccatggttacagggtgagtccaattctcggtgcccacttgtgtctggttcctgacaacttcagctctagatagccatccttctctctagaagtaccttccagtatgtatgtatgtatgtatgtatgtatgtatgtatgtatgtatgtatgtatttatttattttgagacagaatctcactctgttgcccaggctggagtgcagtggtgcgatctcagctcactgcaagctctgtctcccgtgttcatgccattcttctgcctcagcctcccgagtagctggaactacaggcgcctgccaccgcgcctggcttattttttgtatttttagtagagacaaggtttcactgtgttagccaggatagtctcaatctcctgaccttgtgatccacctgcctcggcctcccaaagtgctgggattacagatgtgagccaccgcgcccagccaagtgtgtgtgtgtgtgtgtcgagagagagagagagagagagagagagagagagagagagagagggagagagagagagagaggagagagagagagaccgagactgatttatagttatggtcctagctccttatggtaattaaaatgccctgcctatgatttgtgtaaacttggtgtgattatttttattgctacagtatttggttttaagcaatgtaagaatgtcacccccctcctcccattccttttgtgatgtgaaatgcttcattacttaggaatttgctgctgattgtacagtttagcatttgatctttttgttaaccacagtcaggtgaccacacatagggtaattagattaacccacccctcctcttctccactgaaacaatgtaaaatccaatattctattagcacatgccttccgtagattaatgatcttggagttgctgcgtggaaatttgcatagctccctacagctctaagaaatgaaaatgcccagctgtctaaaagctttaatcaggaaatgagcatgaaatggcattgttttgtcacgggcttggaataatttattcttgacaatcgagttatcctggatataaatgtgtataaacattctttcaacaaccagtaaacaggtgcttttttgttcgttaaaaagtcaagattttcttgacttgggcttggctttgaaatcgttggccctcgtgctggtcactgccaaaagtttatactaaagtcattttccttgtccctcctgttttaaatggcagtttctggaggctggcctttcagagcaagaacggtcttagggagtgaaggaatggggacatggccataggaccacacggggtcattcctcacccagccccttcttgcctgtgttttcatcccctcttgggacctactttcccctatctgtcaaatacaaataataatggcccctatctcttaatgtggttgtgagcattaaatgtgttatcccatgtaaagccttagaaaagtaccttgttcatggtatattcttcataatggcgagctaattccataagacatagggaaatgaagatgcaattctgtttctttttctatttaaaatatcctagtgcacttaaatttttttctgttagactattagtcttggaagcaattgtgactataaatgctttcatttatgttggcacaccgttaaaagaatgatagaactaatgataatggctaacattcattgaatgcctgggagtgaaagactgaatgaggcctattcctgactcttggggctagacataaggacccatgcttatagcccaggggtgtgtgacaggctcttactcatcatcaaagctgttaaaaagacagcagaaacggcccttggaccttggatgttgcttcctctttttttctcctccaagagcaagctttttatctagcacgtgatttaacagttcctgtgttgggggtactgtttcatggactaggtatgatgtagtgagaaacattttaaaatttttccagaggagactttgatgggaaaaatgcccatccctcaggggactcaatttgagatcgtgtaattaaccttttggagcataattagccaaactgtttagctctttttacttgtactctgggcaccaaagaaagctggatcctacccatgataaaactatcatcaataagatttaatgttgcctctttatatgcattttatttttcttgattgtcatgcccttagttattcttgcatttcaagaatctttttttttttttttttttttttttgaaacgaagtctcactctgtggcccaggccggagttcagtggtgcgatatcagttcactgcaacctccgcttccagggttcaagcgattctcctgcctcagcctcccgagtagctgggattacaggcacgtgccaccacacctggctactttttttgtatttttagtagaggcggagtttcaccatgttggccaggctggtctcgaactcctgccctcaggtgatccgcccaccttggcctctcagagtgctgggattacaggtgtgagccactgcccccggccttgaatcttgaactttatatcacatgactgaaaaaaaaacattgattattgggttttgcctgattttccccacatcttagctttcctgtctcccctgcttaatgaaacgtatggactggagagctttctgtaaatcttttgtgtatgttagcatacactgttggatctttaaaatcagtagtggaaattatatagctaaactcttattggggggcagtgtcaacttcttccttgtgtcaatcaagaaaaatgatgagacaagtctcaatcattttaggaagtttatttgccaaagttaaggacgcacgcccgggagacaggtgctatgcctttctctgaagatgattttgagggctccaaatttaaaggcgaaagggtgggatattgagaagtatacaattttcacataagaggcgggtagggaaaaatagttattcatgtctttgtctggctcggtgaatctgcttttttttttttttttgacataagataatatagacaaatggggcagaggaaaaatgcagggaatctgtgtttttacataagataacatagacaaaatggggcaggagaacagtcagatatgcatttgtgtctggtgagcaggggacaactgcacctgtaaagataagctatcaatttacattgccatggtgaaatcttaagagaaacaccttagggtaaagaccttggagctcactaggaatttccttgtgggtaaaatatggggtaggcatgtagtttttcatcttgtagccattgtattcaggaaccaaaaggggaggcaggtttgcgtgacccagttcccagcttgactttttcctttagcttagtgattttgggaccccaggatttattttccgttcacacttgtttgcaaaaaaaaaaaaaaaaaaaagcagtcaataatttaacgatcaggaaatagtaaacatatttcaattactcaatgtttaagttaattaaaattttgaatagctaacacaggcatatggtgccagctaaaagggacaaaatatatgctttctctgtccctcggccacctggttcccctccctggaggcagcctcagttatcagtttattgtgtgtggcttctgtattacacacagaggcgtacatacaaatgtacacaaatgctagcatacgttaggctttttttttttttttttaacctagcaacatgtcttggtgattgtctttcttggtacatacagactgacttcagtcttggagagagttgcatgggattgatttatggccattcatcagctgctctctactgatacacatttatgttctttcagtcttttgctaatttaagcaatggcataacgattaatcttgtacatatgctgttttgcacgtgtatatttgtagtttaaattcctaggagtagaaatactgagtcaaaaggcacagacatttaaatttttgatagacagttgtcaagttgcttcccacagaggctgtacaaatttatttatcaatttatactctacttagaaagtatgtgaggctctctttccctacacccttgctgacattatcaatttttttaattgttgacaatctgacagataaaaatatctcattgtaatttaaaaattaggtacatccctccctaaactgtcaaattctggagagatttgttcttggggtcctcatagcccccattctttgagaggaccagctgtgtgccaggcactacgtcacatgctgtgaaaacaaacagtattctgagagagccagattctagtgcgaggacacatgtaaacattattataatatagtatgtaatatatactatagtataatatagtatgtaaatgctacaattctaggtatgagaaaatagccggaatgatacagggtccttctgtgtactgagcactgtcaggcactgttgtacaggaataccactgtaattttcatttctcttgttgtaccaggacaagccgcagacaaaactcctcagacaccgagttaaagaaggaagtggtttattcggccaggagcatcggcaagactcctgtctcaagagccgagctccctgagtgagcaatttctgtcccttttaagggctcacaactctaagggggtctgcgtgagagggtcatgatcgatttgagcaagcagggggtacgtgactggggactgcatgcagcggtaatcagaacgaaacagaacaggacagggatttttacaatgcctttttatacaatgtctggaatctatagataacataaccggttaggtcaggggttgatctttaactaccaggcttaggtcaggcaggcccaggcctagtttcaggtctggttcctaggcgccaggctacctgcctttagtttcgcttctctttctttttctgagtataaaacagtataaaacaatatgagacgttctgtctctcttctctcatcgtgaatgcagttaagcatcttgttgcatgtttgagtcatttttttcttttttatgtgacctgtcctttgctatttttttgttgggttattgatcttttgctgatactttgtagaaggagctctctttatagaagaggcaacattcccccagtttgtcttttgtcttcgttgatgaattttgtcgttgttgttgtttgctatgttatattcttagttttctgtaatttatttttatttatttatttattttgagacagagtctcgccctgtcgcccaggctggagtccgatggcgcaatcttggctcattgcaacctccgcctcctgggttcaagcgatgctcctgcctctgcctcctaagtagctgggattacaggcacacgccaccacaccctgataattttttgtatctttagtagaggcagggtttcaccatgttggccaggctggtctcaaactcctgacctcgtgatccgcctgcctggcctcccaaagtgctgggattacagacgtgagccaccgtgcctgccattctgtaatttattgaccctttcttttctagcttctaaattctgtgtcagagtgttaaattatctttgcctttctgagattgtagaaacattctttattttcttctagtgctttaaaggtttagtttttaaatgagtaaattcattttgaatgtctaatattcccagttaaataaagaaataagtattacttgtttttttaaaaaagttagggactacatgaattttcttactgtatcatcttctcccctctgctcctaagcctgatctgcatcttttaaggtgagaagttgatggtgatccagccgtatctttatagggatgatacagatctccatgttgttgcagctttgggctcaattgagaatattctgcctctgatcacttgaggtcaggaattcgagaccagcctggtcaacatggtgaaactgggtctttactaaaaatacaaaaattagctggatgttggtggtgggtgcctgtaatcccagctactaggcagactgagacaggagaatcgcttgaacccaagaggcagaggttatgacagagcaagactcctccctacgccccaccaaaagaaagaaaatactctacttcatctgtagacagccatcttgcccataacactctactaaattggtcattcatctgatagatatttttaagtatccaaacaactggttgatattgacaccctttgatccagtggtaataatctagatgtttagcggggtgtgggcaaacataaaggcaccaactgtcatgcaagtaattacactgtacatcgggaagcaacattatctctttgggacacaaaggtagtcgttctcatttttgtccagtatctgttacttgttgtggtctttatagtgttcatccctttcctgaaggtcaagagcttcttgcccttgttctcatgttcttgttattttcttattcgtgttatgagtgattcttgggagataatactgcaagtatatgatattgcaaatatgcagttaaagattgacatagaacatggtaatagacctgttacatttcttgaaatttccttgttagctttgagctgaaaataccatcagaatatttatgagtatatatcaaagcacttttctgagcatcagcatattttgtaagtatgagaaagccattgtggtgtgagacatcaacgtggttctgctatgtaattttagggcaaattatgaaatatgtaaagcatataacaaatacctatgtgcccatcacccttgctttattaaatcctcatattttgccatatttactttatgttttttttcttctttacagttctaatgaagttggtgcacttggtggtttgatagcatgggtattttcttttattgtggtaatcagatatattttttaaagaaacagaatcttaaagctacagctgaagctccccttggtagtctgccatattctcagaatacttgctgtgtcttcccaggtgttctgagacagaccagccttttgtgaagagagccaaatactgggaaggcacagtctctgcacgaagggaacatactcacggggcagctgttcctcagacttgccttttgcgtggggtggggtggggtcaggggagagatatgcatgttggggaacaatgtgctattctaggtttctgtgtctattcaaagctgtcttgatcagtagacttggtaaaagtgtttgtttttagtgatttttaaaaatctcctgccagtggtaattttgcaaaatggttttctatgaactagtgcagggggcacagctgtgatcctgcagccacgtctgggtctaaaggaagcctttcctgcagaaagcaatagagcaggactgagggcaggctgatgaatgatgtctgtttcccctgccctgcttccaccctaagccaagggggctctgcccaacctcactcagctcttcaaatgcagagagaagtaccaggaccagcattctgggcagatcagggtggtgcccagctttccctggtgtccgtggcaccagcctgctctgtgtgccaatactgttggtgacaggagagagagaaatctggcaagatagggggaaaacagctgaggtggagaacaaggatgccctcttgggaacagatccattcatctgattgggtaggtgagatgagacacgcatggctcacctactccatagggtgcatctggcacattccgaccacctgccccattgatgttgatcccagaaaacatctcaccacctgagatgaacattaaaatacccaagcactagctttgtgtatgtctgacctcctaggagaaaatatcagcacatttcaatttaaaagaatctgtcttctttcagtttaagcatttgtgctgttcttttaaattgaaattgcatgcagtgaagtgcagaggtcttagaagtacagttcaatgaatattttggtctatgtacacctgtgtaaccaccacccagacctcgttataggacattttcatcctcccaggagactccctggtacacctccccaagtgtaactgctgttctgagatctctcaccaatgattaattttgcctgttgttgggtttcacataattggaatcatacagtacatcatcttttatgtctggcttctgtcattcaacattatgactgtgaatttcatctgtgttatgtatagttctttttaaaatagtatttgctatttaataatgagagtagataatcaatttgtatactactctctaattcactctttgatcctgaagacacctctcggatggtgtgtttgttgttagacctcttttacagatgacagaagggctgcatagagactttaagtgttgcccccaaggtcacacctcagataaatgatgacgtcagtactagttctggttttctgatgcacagcatcattctccattcatcgtgaagcctgtgccttaaactgtgttatgaatggtgaaagaagtaaaggatgaaaggagggaggggcccccaaactgatcatattttggtattttactgtgtagtattttggttacagactgaccagttaatttaaaggagttaacactgaacccagccaactcaccagtacctgtaaagtatgaaacggatggtgagggagaagagaaaagaggtagccaacttggctcagcagccagccagatccaggcaacgcagcttatcagaaagcagaccatcctagcatagctcgcagttgcatgcacatcatctgtttgcccggtgaggctgctgtttgcaggccgctgaatgtgtcgtgaatttttgccagagtggcattattctggctttttggtctctgaatgtgggtgagccatcccaggctctgtttggtacagtgcttttgggaagggaatggtgtgagttctcttccttttctcaagtggtccttgtgacacagctgaagcgtcctttgcagcattgataccttattgatggcctcggttttattgtacatgctgagtttccattgtaaagagatcagatctgagataaagagaagctgggtttcctttgctttctgaagaggtttgctgataccctgtctgttctatattgtctttaagcaagcaaaatcattgctgatttatatatgtgggcagttatgtatgcatttccatgagccctcatggcctgtaattctggtccagggtgtggcctctactactgagattataggacccaggttcttaacaaatggcaaaaaaacacgggcctgatggtcagaaagttgcaattaaagacgggggtctaggaacccccagtcccaggaaatccagagtcccatgacctggatcagaacctcggagagctccaggtacttggctgttggcagatatacagaggcaggagttgctctagttccaagccaaccctcctctgcaggaaggagctcttctatgtggatggataataagggacttcaaagatttgggcctcaatagtcttgggctttataggtaaggtgatctgttacatcacttaactgtggagggaagctaaggtttccactggagccacaggctgagtggttttgagtctccctcctatagtcatgccactggttcttcttaggaggtgagatgtactaggagagctctgcctagaaggctcagagtttggtttcatggccagctctgccccttgctagctttgtggccttcatctgatcttgcatcttctctgactgggtctcactattcttatgtataaaaatatatgtttggcaaaatcagttgtttttttttttcctgacagtgttgttgttaggaacaagtgaaaaaatagctgctaaagcactttaatttataagcctttgccagtgtacagttgtatcattgctagcatcatcacctatttttagagcctgtggataggaatccatgacgtcaggattctgtgaacataaggtgttgtccaagcagtgcaccatcccccaacttatatttgcatggtaattggttctgtggggtcagcatgcatgtcacatatttttagtcagaagcaagtacacagagacttgtggtttgctgttcaatttgaaaagtgtttgaatgaaagcttgtcctgtggtcttttggaagtaactggagatttctgtagggactgacaagaacaacagacgtttgagtgtccattttgcagaggctaaactgggaggggagagattgtaggcaggaagacatgattataatccaggcagtactccaggaaacagtggttaagagatgagctctcgcctgtaatcccagcattttgggaggccaaggtgggcggattacttgaggtcaggagcttgagaccagtctggccaacatggcgaaactctgcctctactaaaaaacacaaaaattagccgggtgaggtggcacgtgcctgtaatcccagctattcgggaggctgagacatgaccattgcctgaacccggaagtggaggttgcagtgaactgagatcacgccattgtactccagcctgggcaacagagtgagactgtctcaaaagaaaaaaaaaatgagagagatgagctctgaagctagacaggttgagttccaatcctggctcctacttgtctgaccttgagcaagtttgcttagccccctgggtcttgtgtgggtgtctgagtagggccatagtgtagattaaaagttgcagtccaggtgaagctcttagagcggggtttggcacatggtaagcactcagatgttagctgctattcatgtgggagtcttctattcattttattgtggtaatatatgtaacataaaatttaccattttagttattttaagtgtacagtcagtagcattaattacattagaatgttgtgcaactatccgtactatctatgtccaaaacattttcactactcctgagagaaccctttaactatcaaacagtaacttcccattctgcctctcccaacctttcaggtaacctctaatctactttctatctctatgaatttgcctattctagatatttcacataggtggactcatacaatgtttatccctttgtgtgttttatttcacttagcataatgttttccaggttcatccatgttgtagcatgtatcagaactttattccttttcgaggctgtataatattccattttgtggatataccatatcttgtttatccattcatctcttaatggacacttgggttatttccttcttttggctattatgtataaagttgcagtaaacactggcatacaagtttgccttgggggcaaagctttcaattctgctggggtccctgctttcaatgcttttgagtatatacctagaagtggaattgctggatcagatggtaattctatatttaactttctaaggagctgccatactgttttccacaggagctgccctattttacattcccattagcaatatacaaagattccagtttctccacatcctcatcaacacttgttttcttttaaaattctagccatcctagtaggtacgaaagggtatttcattgtggttttcatttgcatttccctaatgactaatgatgttgaacatcgtgtcacatgctcattagccacttgtatgttttctttggagaaacgtctattcaagtcctttgcttggcatttatatttttttccctttatgtttttaagatactacaggaggacaaaaaagaaacagattgagaaagtagatgcagccagactgggcgactgcttagatagggggataatactgaattttctactctgggtaattgggtggatgatggggtaccaaagaagacaggctgccctttcctgggagaaggggcaggttggagaaaaggtattggctttgggtggggctgcattgagcttgggtgttatccaggtggggagcctatagaattaactgccacggccatgtgtccgattggtttctctgaaaaaaatgcaagacatattttaggttttgtctcctccctgcttccacctaaagaagcaacttaagcaattcactcatcattcagcttctctatttggcaaatgtgaacaattactgggggaacaatggagtctggaatttatgggccagcctctctcctggtgccagtttctcagcccttcagcacctgctcttgatcagacccagtccttcctagccagctgctccccacgtgctgctctgaagcattggggagtaggggtgagccttcttgagaaccatggcttctgaggctttctccagggaccaccccagcctcacaatgctggcgctgcttctcccacccttccccggctgcatgccattagcagttattgctaagtagacacttgctatgtcgtcctcaacccactgactttctctgagttactccttggcaaagttgggtgttgtgctctgttgtgttactgcatcacgttgtgtctaggtggggaatttgcacgtgcacagtcatacccacactgcgatggaaaatgaggtttgagcaactgttcttcccccaaagaagcaaccggtgaggaaatgagcccacttggtggcttgttgtctttactttcagagccagagcaggctggcagccatcaccaagttagcatcctgtcatgtggctcaggcgggcaatgtttgcagattgtcccctgatgccatctgcctgtgaggctacaggaacccccagcaactgctgctctagcaggtgctggggctgctgaggtaggtgtccgtgtacatatattcaagcacacacagctttgtgtggtgtgcagaggtaccggtgttgggctagggctgagcttcgcctagttaggcctctgggacgccagttgaaacactcaacctagcaaagcgccagccccagttgttggtttccggtggggccctggtgagggaggaagagagggtgaggctgctgtgaacagaggcagcaactggggaattggatatggtaactaacacactcttgagtgtgcaggaagctgcggggagtggcattgttttgacaaacttttgttgctttctttctgcctctgccctctgctcgggcctagtcatggccctctacccaatttagcatctctgttccttccagcggggagcccatccccatttcttacctcatgggctctttttaaggagcgcattcctcatctttgagctcttcctgccattcagccatgctttgggtcagcccctaagctttcacttttccccaagttactgtgattatggattcagacaagcctagaaaatccttactcctttggggggaattcctgtatacagacttatactttgtgagtcactattatcttggtctaataatgctttttaaaacaattatgtaaattattaaagcaatttgaaataattatattagccatcagatttcagaaatctagatcttaatggagctttgattaagagtctacctagagcaggggtcagcgaactttttctgtaaagggccagatattttagactttgatctctgttgcagctactcagttccgctggtgtagcatgaaagcagctgtacaaaatacttaaatgcatgagtatagttgtgttctaatgagactttctttacaaaagtgagtggtgagctttcatttgctgacccctgatctagagtgataagccatccttattttttttctttgtcaagagttgaaaagccagaggaacttgatgactgtaaatgcattagaatcatcttcttttgggtttagtatccttgtgagcacaatggtaatttgggaatatgcttctttaaatctctgttgagaagaagataaatcagaaggctttttaagggggtgagtctgcttggccaaagcttgtcattgtttaacaagaacaggctgtcacttagagctgtatggtggcttttatgtttcactcattctctttatagtcacatggaatggccatagttacataaggtcgcctcaccatactggggcttattccactttataggaccaggtgcttttctaataaatgtaagaaaactacaaagatacagaaaatggtgtttttaaaacatgatgttatgctaagttggcattgctatagttcatttccagaaagatggagcttaagatagtccaagaggcattctaaagtttcaaactataatcttgttttccttttatctgtcctcacaggaaataaagaaagagatgaagaaagaccctctcaccaacaaagctccagaaaagcccctgcacgaagtgcccagtggaaactctttgctgtcttctgaaacgattttaagaaccaataagagaggtatggaaaaggaaaaagaggttccctccctgcacacaaacaaaagctggaaacttctggtgaactgtgtcaaactttatattgctgaaaaattgaatagagtttgtccttttggtttttggtatatattttggatacacacatacatacttggcaagtgactatatgtatagtaactgtaataaagggaactaataaaaatattttttgacagtgggaaagtagactacatttgtaaatgatgatttttctggagctgtagatttcactttcatatctatttttatggatgaaaggtgaatttagagaatgctgtggtgcaggcctgagccgtgtgtctgaccgcactctccctttaatttaaggcaaaccttatcaagttatttctctctccaactgctaggctccctagcgcagaccctgcctctctgagtttgtgaggcagaatgtgcaaagatatagctaacacatctgtctgaccagaagacctttaacaatcttgttttctctcttttgagacctcaaggcagattttcaggtatcagcttgttggagttttgttttttctcccatcccctcttggtgataattgtttgaaataatgtgagagagaatagaagactgcagagacgaccccactcaattttatactgtgagcacactagggtccctccgtttttcctgaccttggaccagccagggcacatgctgagcatgcctgtaggttagcgcttggctgccagcttttagtgggcttattacttccttaaagagaaatagagagctgtttgaaagcaggcacaggaactagattagcaaagggttccattaaccagaaaaaaagaaggcaagtttatataaccatggggaggaagaacagctaatctttcataaaatttagacaggataagaatttgtccagtaaactgcccattgatcatagctttgtgcctctcttcctttctgtctcttcctctactgcctccagctgccctgggttacatttccctttttgaattattcagatcaaatattggctggaggcccatgttggttagcagctataggattttctttcttttctcgttttgttaaattcatcctaccaaagcaggggatttcccattttaagaattaagtgccctttgctgtaaaactacagtcttgcccaaaagtgcctcctgcattcttgcaagtaagctctcaaactcctgagacctgcattcattggatttggtgaggtagagttcagtgtgtgttctttctgcactttcaaaccaatgagaaggagccctcccattcctccacctgcctcttgggtccgcgggcacggcaattgcacgcatgttgaccagcggcaaggcctctttggccagccatggtttttgtcaagtcagtaagagatttaaagtaattaattaatttaacaagataaggaattaattaaggtaaggaattgaggtaactatttggatgagtttagtaaaattacctgagaactttaaatcaacgaaggaatagaatttttcagatgattatctcttcaccactgaaaatctggcctctgagttcccctatggaatttttcattcaccaaaaattggaatgcagagggatggcttactgccttacattccattttgaaagctttctgccttggacctgcagcctggttatggccaacctttcattctgaggcattttatatgtggaatctgccggtggttgtgggacctgagtacatggaggcattctgtaaatatgaagtctataacaaatcatcttcattctgtccgaggcttcaccctgacctcctgggtcacctgggcgtaacataaatttccagctgaagggaagcattgtgtaccaggcccagggctgcctctggccctcccccaccagtcaagactaccagtattctgctaccccttataataaacagcgggggtagattgattggccttgtcaggccagataaatagttcattgtactgagctcaaaagctacatttttttcccacccaaaatcaatgaaaaaaacacttttttccccccttaaaacaaggatcagaggctaaatctgtgggatgattctagttacttgtaaacacttcggtccaactaatttttaaagttttatgagttaccataagtgactgaaggggcctccttcccctttgtttccatcatcgagctttgtctccagcaacctttcggatgttttggtctattactgttgttgtggctattagggaaggaagttgctttcaggatttattaacagcctgctttgattggctaacatgggatcttagaggatatgagttgagtccaccttgtgattcagtcttggacccttgtaagaatttaatagaatgaacacaagttctcttccttgaacttgatcaaagatgagatgactgttttctgtatatggaccttatcatttgatacatgcttgaagttggattaataatgaaagattgacatctatttctatcatgagtctgaaactgaaccacttcattgggtcctgaacttgagatagtcctagctgaagaagtttgcccaattgtgtccagctgtttttgcgtcttgtgacatgcctcactttgcagcaactgcaaacaggtagtagtccctcacgttgtgggatgagctcaccctccccagacacctgcataaggtcagaagacatcttgggtttgaaggaagctattcatagccttgagaaaaagccagggctatggaaaccttagtttggggactgattagtttcacttttcagctttaacgtttgtaaacgtctgcagagttgatttagggggtactggaatgactccatgggctttttttttctttctttctttctttcttttttattttttggaaacagggtctcactctgacacccaggctctcactctgacatccaggctggagtgcagtggcgcgatcatggctcactgcagcctcgacctccccaggctcaggtgatcctcccacctcagcctcctgagtagctgggactacaaggtacgagctaccacacctggctaatttactgatttttcgtagagctggggttttgccatgttgcctagctagtcttgaacgcctgggctcaagcaagcctcctaccccagcctcccagagcactgggattacaggtataagccactgtgactggctggcttttcatttgagaagatgatgtgactggaattgagagagagaaagtacatcctcccagctgacttggcagccactggctacacattctggcattagaaccttaggggcacttgtgtctgcactcacttctggccatttctgtggtccttacctgagtcacagtgaaagagcttcctgtttaaaacaagcctttcctgaggaataagaagtcgtttttcatttaaacttgcagcatggatgttgtatgttctgaagttatcccagactccagtatatcgatgagttaagccagaaaatgtgaaaactttacttggagccaaatgtcattctcttgatgaaccagacagaaaagagttgtatgttttcttcaaagaatgattgattcttttgtttcttctatcattaaacccataaaagagaatgatgggccctcctaaattggagcattgatatatagagacttttttaaaaaagcattcaaatgccgagattgtgccactccagcctgggcaacaagagtgaaactccatctcaaaaaacaaacaaacaaacaaacaaaaaaaacgcattcaaatgttgagtttagaagaaaaattgaataaaacggaagtttgaacagttagcatatatcctaaataggttcttgaaaatgaacagtggatttttgtccatttgaatatagactcttacctacttgaattaaaaatgaaataaaaaaatcaagctggacacagtgactcattcctgtaatcccagcactctggaaggctgaggtgagaggattgcttgagtccaggagctcaagaccagcctgggcaacatagcaagaccccatctctaaaaaaaataaaacaattagctgggtgtggtggcatgcacctgtagtcttagctactcaagaggctgaggtgggagaatcacttaagcccagaaggtcggggctgcagtgagctgtgatagcgccactgcactccagcctgggtgccagagtgagaccctatctcaaaacaaaaaacaaaaaaaagaaaaaattatttgatccttagaaggatttcctggctaactttattcatgtgatcagttaagtatccaggctgtcatcaataccctgctggcccgtgtgaggaccaggttccatctcagggttctcgtttgcactgttaacagtgcatgcagagaagatgtatctctgcctctctctgaacctctcctgttgcctggaattttggacattgttccttcctcactttttggtagacacccatgaacattcaatagtacatgtttagtgcatgcccactatgcatctgcccttgtgcttggtgatggggcagataaagactggaaaaacaccagccagtcctgcctgcaagtaactcagtctgttgtatcccttgggaaacgttgagaaagtgctgcacgtttcttatatcattttgatggcaaggtggggatgtgtcttgtatttacttctgtcattctgaatgtgaagccactccgtgggtttctggttggctttatatgtccttgtttctatttccagtttatcatgaattcagtgtttggtaagtctctattgtattttgcacatttactattttttgctatattattatgctctcctgatacaaaatgtattttatagttacctttttaagtcgctctgctactttggcatctgccttcccaaagataaactgcttttaccatctttatttaaggttttttatgcatttgcattttactgccccttccagagattaatgctgaaagatctgacggtttaaaagatgttatttgtaacaggtctagctctgatgctacgaggtgagatcgtctgtctcatgagattcaagttaagatgggggagggttgctctctgaattgatatgtgggtatgactgattgtagaacattgctctgtgggttcatttctggtgtgtttaatccttcagacgggttccattcaaaagttttccttaacagagggatcaacggctgctcttcctctggtgacacactgttgctttaaaagttagtgcagaagttcttccacattaatatggacctcgtgtttgccacatggaagggctctccagtttggtctgctacctgtagctgtcagaagaatgttgcttaatgtttacctttcttctcatagtttcagcactggtcattccaagccctaaacagatctaagtgactgcccgtcctttccccacttcccctgaaggggaaacgttttttctagcttttagtgtgagggcctggaatgcttctcatggcgccaaggcggtggcgtggatcttgataggccgtgagctctttggcagaaatgaaactgttaacaaaggatggaaagaagtatgtccttagtaaagaaaatgtcaacctctttggtttgccagtggtttgttgtttaaggtaaatgtgagatctgggggtttgtttgtagagatgagactttgtttctttcaaattttctattggagaaataaatgtgaattcttgccagttaactgggaatctgaaaatgtgccatttggggtcagacttttctttgagtttcaagattgcctgtttatttgacttaaggagctggtgtttatggacagatagaataagagttaacagaagacattactgttgtgtagaagctcttggctatcacctgagctggtctttcccaggggaaatgaaaatctggcgatctggcagtgaatggggatagatatgatacatagtcattcagtaatatatacgtctgtgtgaatgtatctgtatacgcatctatagtcttattttccagtgggccttcattctcaaaagctctggagtcaagagcctttaaagaagtcttttaaactaactgatccctgactgcatttctggcaagttttattgggacactgcgttgttagcaccagcaattgatgttggagtgtgtgttaccctttttcatgttattttctgaacctattgagcctagagtgaggggtggtgaaatgcatggtaagaactacataggagggtatagccatcatgttgcgattatgtgtgggtcattgataaaatcggtttttagatttttttttctgttatgtttaatctcctttctatctctgtgtcttctgatttcaaggcattaacactaatgagtctcccatgggttagtcatgggtttaagactcccgccatactcctgctggtgtccgcccaaatccacccagaggacaagccatgaagtgggtttgtggtggtggctccacctggtggctctcctaggaaactcctctttctgcccaccttttccttctccttgggagaatcttgatggaggatgcctttgattcctctgactcagtgttcactatttgtgcagttccatcccagacccacggcttctcacattacttatggatttttttagcccttttgctttttcgcctaagaattgctctttgaactcatataatctgtgtcctgatccttgttctatctgtgatacccctatggaccaggattattgttaatgaggattaaaaaaaaaaaaggactcccataggcatgactctagatatagatattaatttggacaaaataaagaatcacactgaaatccctgtaggtatgtatgccaaaatctcctgcctaatagctccaagtacccttatctacttcttcttcactttttgttgaacccatttttcctcaaaggagcaatattttattaccaatgttgttttcaattgtcagcaggtggcgaaagtaaaaagccaactaactttttggcttcattgttgtttcattattgtttgtgaattctctacaggcagcccccttcttgcctgggcacagactgcccccgcttggtatgtcactgagcataagtatttttgataaataaaaatgtcttttattctcattatttttcagtttttagttgttgataatattgcagatatgacttattttagctgcattgtgggtcagtctgggaacttaatcaccatttataactttgcttctatgggaataatgcattcagagttccaaactctctgcataaggcacatataagtctttttttttttttttttttttttttcttggaggcagagtctcgctctatcccctaggctggagtacagtggcatgatctcggctcactgcaactttcgcctcccgggttcaagccattctcctgcctcagcctcctgagtagctgggactacaggcacctgccaccatgcccggccaatttttgtatttttagtagagacgggatttcgccatgttggtcaggctggtcttgaactcctgacctcaagtcatcccccagcctcggcctcccaaagtgctgggattacaggcgtgagccactgtgcctggccaagtctgacttcttttttttttttttttttttttgcattgctgacatgaatccttaagtacctttgtaaaagtcagagtccgtataatcggtgcccactgaagtttgctcatgttgcagaggagtttataattcacacagtatagaatgctggaactgtgcaagctccacacagtacactaggctctgaggatagctttgggttcaatcacattgcaccattgtatatggtgcttattttcacaaggcctgagttggatcttagtgtgcccacgtttgtatgaggcatgtcgtgaaagtgggtcctattgtatatttccatctactagtgacgagaccttgcaccaagcgtgacatgctcagatagaaaccagcccagcatttctcagtgtgtgttgtatggaattatagcccttctgactattccacaaaggagggatgcggggagagacaggcagacaagcggggagagaaaattgcctctctcgtcaaatttcagctgcagcactaacaccatcttggagactgacaagcacattagcatagtacaggctctcagatggcctatggtaaggagacctgcttatctttgatcatggaactgcatgttattggatactagttaagactccactttgggatatgttgggctttaagatacaggacaaggagctctgtaagcatccccaagataatcttcaggttccacctctcatgggaaatgtttgagtaagtgagtggagatggtggtgctggcactcagagaaatgactggcgaggcttcttaagcctgcgctgtcaaaaaacatgagttagatgatgctaggagaacattctttgaatctgaaacttgaaagccagtcctcttggtagtttttcaagtgacaagctgaaagggaattttccctctgatcatttcttgggtccttgtatctaagaatgaggcttagacacatgagtggaagtcctagtctgggctttggcatgaaaagcaggctgaggggacccaacctagcaactggtgaggccagggtgttcaggtctacctgggacttggatcacgatggaacctgcgattccagaggtggtttttattatgatgacagtctctacatagtcaacatagtctcattgccttctctacttgctttgactgaaagacagaagtcttagcttttcccgatgccattaaaacactgaacgtttataaagaagagccttcttctctccctactagtgaaacaggctggcatttgagttcaagtaataaatccacatgtggggttgtgaggaaaaaccacatagcctgcctttttagaattctggaatcacagagttacagaggttacagagggacccacttattgacatcccaggcgaacgaacatggagcctctgcccagggaattgaaaaggacactccttggctctggccttggctaagccccacgtgggagcctcctttccaaagggaagtttttctgggtagggaactgctagattaatgaaaggtaatcaggccaggtgtgatgacttacacctgtaatcccaacactttgggagggcaaagctggaggatctcttaagcccaggagttcaagaccagccggggcaacatggtgagatgttttatagtctctataaaaaatacaaaaattagccgggcatggcagcgtgtgcatgtagtcccagccacttgggaggctgaggtgggaggattgtctgagcctcggaagtgaaggttgcagtgagctgaaatcgcaccactgcactccagcctgggtgacagagcgagaacccgtctcaaaaaaaaaaaaaaaaaagtaattagaggtagatgatatttaggtgctggttgcatttgttgcattatatggggacagcagctatattcacttgcagtaagctctggaaaaggggcattttcttctaattatatctgttgatctgtcatcacagcctggtctctctgatgccatgtgcagcctcagcttagtctttggattcttggctttttgtgcttctgaagccttaagactgttgtacccaaacaatgaggacatttcatggcccacctccctaactcatgattaggccaacagcgggcccagctgcagtgccaggtgggctgccctcattgtttcaaccaggaagggaaagagagaccagccagaagcttcctctgcatgtgcctgtgcatgaaaaagagcatttgaggaggactagcctgcttgtcgcatttgtgtttctctggagacctgaataggttcagtggcagcaggaccttattgcagggaggatggctgttgggaggacccagaccactcctgctgcacctccacagcttctgcagcactttagacaagttgcagattccccctgtgtttccaggtttcccatttgtaaaacaaggaaatgctcttgttaattccttcagggcaattgtgaagattaaaaatgagtaaagaaaataggttttgggatagggaggcaatagagtgaagtggggtagggtgtcactcactgaatacagtagtaattgctattaaaagtagtaaactgctagtaagaccccagagcattgggaaggaattagagatttatggaaaataataaaacgtgttttcatgaaacaacctgtgatcacatgcacatggcaccttctccaggatggaccatatgctaggctgtaaaagaagtctcagtggccaggtgcggtggctcacgcctataattccagcactttgggaggccgaggcgggtggatcacaaggtcaggagattgagaccatcctggctaacacagtgaaaccccgtctttattaaaaacacaaaaaaattagccggtcatggtggcgggctcccgtagtcccagctacttgaaagtctgaggcaggagaatggcgtgaacccgggaggcggagcttgcagtgagccgagatcgcgccgctgcactccagcctgggcaactgagcaagaatccgtcccccccaccccccccccccgccaaaaaaaaggagtctcagtaaatttagaaggattaaaatcatacgaagtatattctccaatcacaatggaattaaattagaaatcaacaatagaaggaaattggggaaattcacaattacatagaaattaagcagtatgctcctaaataaccaatgagccaaagaagaattcacaagggaaattttaaaatactttgaaattaatgaaaatgaaaacatgacatacaaaaatgtactgcctgtggctaaagcagtgtttcaagtgaaactgacagctgcaaatgcctatgtacaaaaagaagacagatctcaaattaatagcctttctactttctactttaagaaactagaaaagaaaagcaagctaaactcaaagcaagcagaaagaaggaaatgataaaggttacagtggaaataaatgaaatagagaatcgaaaaactatagaaaatcaatgaaacaaatagttgatccttagaaatgatcaacaaacttgataaaccttatctacactgatcaagaaaaaaggagagaagatttcagttactatatgaggagttaaagcgcgaacatcactaccaatcttaagagaaattaaaaggattgtaagggaatagtatgaacaactcacccactgctggtggaaatgtaaaatggtacagccactttggagaacagtcacccatatgacccagtattccagactctagaaaaatgaaaacatatatgtccacacataactgtacatgaatgttcatagcagcattattcataatagccaaacagtggcaacaacccaaatgtccaccagtggatgaatggctgaacaaaatgtggtctatacacaaaatggagtatcgtaagaaggaatgaagtcctcatatatggatgaaccttgaaaacattatgctaagtgaaagaagccagtcacaaaagaccgcatattgtatgattccattgatatgaacgtgcggaataagcaaatccctagagatagaaagtagattagtgtttgcctaaagctgaaggtgggaatggaaagtgatttttggtgggcgtgaagtttctttttggggtgatagaaatgttctaaaattacactgctgtcatggctgtacaatcctgcagatacataaatccatttaattgtacacttgaaatgggtaaattttatggtatgtaaattatatctcaataaagctattaaaaaatacaacacaaattggggttaaaatgctatgtctgtctgtctgcctctttctcttttatgtcccctaccactaacctccttcccacagctgagggacaagatgtgtcattccatttattcaagtctttaaaattatatatttctcagcaaagctttatatttttctttattcaatcagttgcctaggagatagtaggtctgagggatcaaaaagacactgttttgctaagggtgacccaaatattagataatcgatttgagaagggtagagaactggctgtggcatcctattgttcatttcttgagaaaaaaatgagattctctgtaaatcaaaagccaaacctcttatattctaaattctgtgcttcgtagaaagagcctctgctagaaaggaaagaatccatttatgtttccagtttttcttgccgttgtcagtaactgcgttggctatttttgctcataaatctttatccacagctctgatgatttctttaggaaagatttctcagatgtggaattactggacaaaagtgtgtgtatattttatggtacttggattcattatcaaattgacttcctgaaagcttgcactgatctgtctcactactgaagtggggagagtgctgcttagtgttctaagcttgaatttctcagattaatcgagtgcttgaacattttttcttccgtcatttgttaataatctttgcactttatattgaggtccttatttttttttttactggttggtgtactattcctttgtcattcatggcaaattttgcttcccaatttgtttgcttttcattttgtttacgattgattttgatgcacagaaatagtaaatttttatgtagattggtatattgatgctttcttttgtgatttctctgaataaattatcacctagcttatctcctttttttatactggcttcattttttacttcaaaattttaatctgtatagaattttgatgtgtagtatgaggttagtatacaaattgatttttattttgaaatagccacttttccaggaccatttattgaatagccctttccagtgattgtatgatacctcatttatcatataatattattatatatatgaaagtctttgggctttcaattctataccattaatttgttttaccattcttaatatggttaactattatggctttataatatattttaatatattgtatggcaagctttcagccttcctatcacccttcattttcaaaaaggatttagttactctcatttattttaaaatcatgtcatcaagttaaaattttaatttcattcaaattataagtcacttttagaagaattaacatttttctaacatttttgtttaaagctttgcattgttgcataaaccaactttatatacaagtatataagtgaaaaccttttctcccccacctctcctccccaaacatcacagtaggctaattcttgtaaattaaaacatctatccccttctgaattctaaacagcttattctagtcagccagtgacatgggatgtcactctgttgagtcaagtgttacagttttatttgtgcagtcttgcttgttgatgacgttattcccagatagatagtggttattgttggcttttgtaaataggatctttcccctcatattttttgtattgctggtacgtagaggaatttaacttttgaagatttctttacaatagcccttgtggaacactcttgctaattaaaaaaagttcctcttttatatttagaaaattattagtacctatcagtcactagttttcagaaggtggataagtggaaattataaaatgctgtatttgaacaaatgatattttagaaacaaaaattccttggcttggatagaacgctgtgtgtgtgtgtgtgtgtgtgtgtgtgtgtgtgtgtgtgtagggatttttatccaaattaaggaattttatatatacagttgacccttgaacaacacagctttgaactgcacaggtccacttatatgtagatttttttcagccaaatgcagatagataatacagcatttgtgggatgccaaacctgtgtatacagagggccgatttttcccgtgcttgagttccacagagccaattgcgagacttaaggatgtgtggattttgggatgcgctaagggtcctggaaccaatctgccgggaatactgagggatgattatatatgtatatatatgcagctgttaacagtgttatattgtatatttcaaaataaacagaagattttgaagttttcactacaaagaaatgataaatatttgaggcgatggataagctaaatacccttacatgatcattatacaatgtatacatggatcataacatcacactctaccccataaatatgtacaattattatgcgtcaattgaaaagaaaacttaaaaaagtggacatgtgcaaacctcaaaaaaaatcaaaagctaactttcattagttcatattatgaaaacaactgtttttgtttggtttttcaactatgacagtatattaaatgaaaaaaggaaaaccttagtcatctgatcttaatgatttgtaatctgatcttagtgatctgatcttaaatgaatttttttatatatttggggctgcatttcattctattaatgcatttttattcttccgcaagtgttgtgcatgtttaggtttttattttctttactagattataaggcgcttgaaggaaagaaaccacatcttattcatcttggagctcactttaattgttgaatgaagtatatgcttgtactcatataccctaatccttttgaaaaacaagttacttcaaggcaaactaccagagggagaactaacttattaagttacatggttaaggggaagctgttgaaattctgtgattcagagaaattgtctttggtttctgagtaccgagggagagaggagacttattaaacatctgttttaagagtggatcctagaataagtactaaacctaggtcttggcctgaccacaggcagtttactagagagagagaaggtgaaatagtttcagaggaggaaattgcaactagatcttgagtaatgagattgaaggtggagctaagttagaagggtaacactgtgctcaaagagaagggtcctaaaattttcacattcacttgtgtaacatgcgatggcgagtgcgagaatgtatacaagacaagggaaggtttcaatttcatgtgaacattttaatctatatttgattttacccttttgcccaaggttttataaatgaaagtgtaggccgggcgcagtggctcacgcctgtaatcccagcactttgggaggccgaggcgggcggattacctgaggtcaggagttcgagatcagcctgggcaacatggtgaaaccccgtctctactagaaatacaaaattagccgggcgtggtgacacatgcctgtaatcccagctactcgggaggctgaggcaggagaatcgcttgaacctgggaggcggagggtgcagtgagctgagattgcgccattgcactccagcctgggcaaccagagtaaatctccgtctcaccaaaaaaataaacaaataaataaaataaaataaaataaatgaaagtgtatagagttcagtttattttctatatagatgtgtactcttccctttttgttggagtacatgggccagacctagcttttccttcatttctgggcttttccttctctgatatttgattcctcatcactttcatcaggaccagggagggaaagttaattttggactatgtgattatgcatcagttttgcctgtcaggaacctagtattatgaatgattaatgattagtattgttctaagatttcaatttaggtaaaatttatctctctaaccacctgcagcttgcttgttgaagattctgtaacactagagcagggaggtgacaatccctgtgggggtggcctgagaagctcttttctcccctcccacccttagtctcttcttgcttctttttcctctctgcccccttcttttctccctagggcccacttggatggattctttggtattgtcattccttacaaaggaaaataaaaattcccagatagtttgccactgagttttccctttaattattttacccctttgctagcccacattatttgagagattaaagcaaacaaatgaacacagcgtgctgcttaatagttatttcttttatggaaatagagttctgctatgttgcccaggctggtcttaaactcctagcctctagtgattctcccaacttggctgctcaaagtgcttaatagttattttttttaaatattgtttagggaaaaaatgataccagttgttttatatttgaccttttttaaaaaaaagctttaaagcagctctttgataatatcactagaagtagtttatttctttttgaagaaattagcttcctttgtaatttacttttgactacatcattgagataaaaggtaaggcagttgaaactatgtacaaaaaggaaaaaaaaaatcgctcagttactgatgggtctggcactgtgtggttagggatgggaaaaccagcatacactagaaatgaaaatcctgtttctatttcatacgtatacatatactttaaaaactttacatgttccctcctaagctttggccctgtagctcttgcccttcttgcacagaactcatgtgcaattcacattaatgttgaagagactcctttcctccctccttctctcccttcttccttctttcctctgttcctttcttcctctgactctctctccatccttctcttccatactttctaaggaccatcccattctggagtgggcccttagggtgtgggtatatttaagtgtgtgtcattagctcttagttaccttttcacagagttgatgggaataaaatggaccattgaaatccaggaatgacccacagaaatgcttttgcagtttaactctaaacctttttattagaaaggcttatataggatgtgatttcacttttctcacttcctgctgatcctctcaggtggaggtgatcataaatttaaaaatgaccaaacctaggcagcaagaaggaagagaggtaagcatcagctggggattttgtaggatcagtctctctccttccacatgttcataaattatgaactgtatcgatccattcacattgatgtatgaactcattctgccaaaagcccaagttgaagtggaaaatggaaagtgatcatttattagagctgatgagtgtcagctttgtactgaaacaaagaaaacgaaaccacacaggcctggacggcctccccttcaaccctaagattctgtggccagaggcaagtgggcctgggggtaaccagcaagacttagtaacagtttacaaatatcctgcctgttttcagtggcttggaatcagactgttatctccttgaggctggaaaagcatttctgtgcctttatctccccatgacttctgcccaggatgattcagacaccctcactggaattatcttcatctgaataattctcagctctatcagccattatcaatgttgggaaggttatttcacctttttaagcatcgatttcttcatctgcaagttgaaaggttgagaagtttctagtatgtcttcagctgggcatggtttctaaaagcttttgttcctatcttcatcagaacataactagttctccagttcagggtcatggtactgtttatatagagtcctcaaagcattttaacctgtgagccctcatttggttattaagcttttggaaatgttgaaaagcttaagcatcccacttctctctttgcaaaccctccccaacgttcccaggaagaaatattggggtccagtctgtgtaccatcagcccattctagctcctacagctgacaaacatttgttgaacaaatcaagttcccacatgaccagtcagaagcctctggagagcttcaaagaattctttgctgagaatgccccatggtgattttgttgagtaatgaagttaaaataatgtttctgtctttggtaaaccacccattctcacctactgcatggcagcatgggtttctgccagtctttactcagcttgattgcacaaggttgggcaggtggtgagatgtgtattcactttgccttcagctcagcatgcttcagaatacaggtttagcatcccaaatgtgaaaatccaaaatctgaaatgctccaaaatctgaaactttttatgtgctgacgtgacgtttaaagaaaatgctcattggagcattttggatatcagattacagatactcaactggcaagtataatgcaaatattccaaaacatgaaaaaaaaatctgaaatccaagacacttctggtcccaagcttttctgatgagggatattcaacctgaactgcctcttccaaaggcttttgcatatcatctccatatttatttcagtgggtgtgggatagaatcacaaattctagctgccagttccttctcctcaacctgttagatgatagctaaagattgctagctaagtgatacttttttatttgagatggtgtctcgctctgtttccaggctggagtgcagtggtgtgatctcggctcactgcaaccgggttcaagtgattctcctgcttcagcctcctgagtagctgggacttacagtcacgttccaccgcgcccagcacgtttttgtatttttagtagatactgggtttcaccatgttggccaagatagtctcaatctcttgaccttgtgatctgcctgcctcggcctcccaaaatgctgggattacaggcatgagccaccacgcccggcctaagtgatattttttaaagcatgtttaatatttcaaaatgaggttttaacagagacacatagaaagggatcaacaagggacttgaacaaatatttgcacacccacattcagagcagcattattcgcaataggcaaaaggtggaagcaacccaagtgttcattgaggatgaattgataaacaaatattatccagccttaaaaaggaaagaaattatgacacatgctgtaacatggatgaactttgaggacattatgctaagtgaaataaaccagacacaaacagacaaatactatatgattccacttatgtgaggtacctagagtagtcaaatgtatagagacagaaagtaggatggtggtttgcaggggctgagggagggataatgggcagttattgtttcataggtatataatttcagttttgcaaaatgaaaagacttctggagatggatgttggcgatagttgcacaacaatgtgagtgtacttaatgccactgaactgtacacttaaaatggttaagatggtaaattttatgttatgaatgctttaccacaataaaaaaggatcaagaataacatgacaaatacccaacacccttctacccactaccagctaagaaattctatcaattagcaattacagttgatctgtcatgtatgttaccttgtctcagttgcattgtgtgtgtttcttgagaagcgtgatggatgacttgggtaagagaattctgggtcaagagagcattccttctcctgttttcttttcatttttatttgttagttaaagataaacatagtacaataagtaaaaaattaataacctttctctgtcctttaaaattagtgttcctaactctaaaaagcaatgtttctagaaacttctgtttaccctttgggctctgatgaatgtggagaaaagagagagaacacttaactcaccaggatggaagaataagataaaatatttgcaacctccttcctccctgaatgttgtgttaaacgtttttttgaggacttgcgctgtgtcaagtgttgtcgtatcagttatctattgctacaatattgctgcataacaaattactacaaaaccccagcagcatacaacattaagctgctctgtgtatcttgcttgcattatgtgtacaacaaacccctatgacatgagtttacctatataacctgcacaatgtacccctgaacctaaaataaaagttaaaaaaaaaaagaattaggaccttaatgcaatcagtacgccctagttacctatgcaaatgttgtagtggagacatctatgcagtcctttaaacaaccctgagaagtaggtggcattggcctcattttgcagttggaaaaagcaaggctcagagaggttataagacctatccaaggccacactgttagtgagtggtgtagtttgggtttgaacctgggtctgtcagacgccttcctccatgccgcctctgccaaactccatgcagcaccttggattaccacctatggaaacattctgttttgccttttgtgcttctatttgcccctcccactcccgctctactcctttctctattatatttgattgagtcctcttctccaacttctgaagtgtaagctgtttctatagtcctgtctttggcatcttcctgggttcagctaatgccatgaagcatacgattccctaagcccaacctctaggctggccctccctccttgctgccttcatgtccactctcagacactctgtgctggctactggtttctgggctgcaagtcataggcaacgtggttccatctggcgtaggtcatgaggaaatacctgtcttgtgtaacaggaagttgtacacacacagggcaggcttgtcagggcccaggtttcttttctgtgccctgcctctcctggagttggctttgtgctgtgaccagcaagtggagcaacagtggacttcccagtttacatccagtggggaagtgcaggggacctctcttcatttagatgctctgggcagacccacctttgtctctcactgtaccaccctgacctaggactgcctgcccatccctgaacctatttctggtgggagctgacccacgtctggtggtctgtggtggagtggcagatgggagacagtcactgtgtccccaactgtccctatgtggttgagcagcagattctctctcctgtcagactcctgttgcttctgtattctgcattttatttgtttttatttatttttttgagacagggtctcactctgtcactgaggttggagtgcagtagcggaatcatggctcactgcagcctccacctccagggctcaagcaatccttctacctcagcctacccgagtagctgggactacaggtgtgtgccaccatacctggctaatttatctattttttttttttttttttttagagtagagacagggtcttgctatgttgcccaggctgggttcaaactcctggtctcaagcaatctgcctgcctcaacctcccaaagtgctgggattacaggtgtaagccaccgtgctcagctgtgttctgcattttagttggtggcattaccaaccttcacttcctcccatcgacactttggggtcatttttaattcttctttcttcttcatccccttatttacttacatgttttgttctaactttgtttatgagatggttgttaaaggtctgttctgggctagcctgtagtaatccccaaggaggccagctgagttcctgttcacagagtctaggatttgagaatcaaacaatccccaggcagcgtgggcagggtaaagagaacattatacactgggtgctgtgctctctcatggttgttattggtggtggtggttgcaggggaccataaccctgcctcaaaagcagtcagggaaggtgtctgggagggggtcacatgtaagctgatgattcaaccttagccatgtctcttgttcttcctttttaaaaaaatattccctggtttctgatttggactcttaacacttcttcctataaaccagaagtcagcaaacgatggcccatgggccaaacctggcactggctgtttttgtaagtcaagttttattggcacacaggcacacccattcatttatgtgtggtctatggttgttttcaccactacaatggcagagttgagtagttgctacagaggccatatggctcacaaagcctgaaacattgactctctggccctttacagtaatagtttgctgatctctgcggcagaccattagaaaaaccgaattcctgcctgccgggaagtttcgtcttgcaaaaagagatatacgtaatatatagaaaattttataataaagccctttgaggtaaagacaattaagtgctgaatacaatatttaaatgctgacaaaaattattgttggggagattaatgtggatttatttttccctactttctctatttttctctgctctttctctattctgcaaatgaatcttcattcattttttttcgcctcaggatttttagactgacactttctagatttataacttctaagtttacacttttcatgacactcactttctgccctctgagagggggaggaaaggtatggatcagtttggaaaatgaagtctgggtgagatataaccccctcttttaaaaaaatacacctttgcacctttcctgtatttacaaggaaagtgggatttgtttaaataaagagaaaagtctttatctgcttcgaataaatagataggacgtgcattactaacctgtttgtttggtggggtcggcgggggacatctgcttaataatctgcccttttctggatgatgcttattccccaccccaccaagaggggactgatttgttgtttttctgatccccacacaatcatctgctcagtagggcagcttttgtgctattgggttgtttacacctctctgctcttttaaaacattttctagtttgaccttttcttttagactcatcctaacttttcttagacttactataaaaataatacatgtttagtgtaaaaaattaacagagtcaagtcatggtgtaaagagtcacatcaaatcccttccctgagtcatacttcctggaagagacttggttcatggtcatccctacagatctctgtgtagatattaggaggaaccataagcagatgcagatagtcatttgatcataaagatgtcaatttcaaacacatagtggtacatacatcttggcattttttaaaaacacagatgggatcatactgttcaggctatattgcaatttttgtattaagttgacgagaatcttggaaatcttgccgtatcagttcatttagagctatgcttctctttgctagtttgtgtggagatacacctatggcttaattaaccagttccctgattgaaggacgtttaggataattctggtttttcactattctgactaatgtagcagtggacattatgcatatatctttgtacatttcatgtgagttatctggagtataacttcctgaaagtggaattggtgttttcttgactcttttacttttaacacttttttttttttttttttttttgagacggagtctcattctgtcactcaggctgaagtgcagtggcgtgatcttggctcactgcagcctcaacttcccaagctcaggtaatccacctcagcctcccaggtaactgggattacaggcgtgtgtcactacgcctggctaattttgttttgttttgttttgttttttgtggagatggggttttgccatgttgcccaggctagtctcgaactcctgagctcaagagatctgcctgccttggcctcccaaagtgctgggattacaggcatgagccagcatgcctggttgagacattttttttagacttcttttttttttttgaagaactggtcagatgcctctggtcccagctggccatgctgaccatagggtccttcatcctctagtgataccacagaaatggacctcagtggaagtcaggcaatccctccaggcagatcctgtgcaattataaacattagcatcaacttccctccttctatggaatatttctgtgcttgcagcccggcaggcactggggacggacacacacacacacacacacacacacacacacacacacacacacaccagtgcgcacgcgcacacacacacacacacacacacaccagtgcagctgagtagggctgggagcaaggggtgtgtatgaagccgtgtgggtacatggaagccctagtgacctctttatacccgaaggatagggggaaacttgtagtgctttccagaatttaagtagtcagaaaagggagagaaaagtagggctgagttgggggagggtaatgaggctgtggcaggtgtcagcctgcaaattagctgtgctggcctccctggaagaaatcatgggcattgagctcagccaagccagggcaccagatgacagagtggggctctcgccagccactgacccaagtaataagagggcacttggcaagcagcttcatgagcaccgtgccacgtggccatttgtggttcaggacttgcgaagttgcccaaagtggctcttttgttatgatgtgttactccaaagcttatgaagcattccaatgaacagagtccaaatgttatgtttactgctttgttaaatataaatagtttacccttgtacctttgggtttccttggaaactgtaatttttttaaagataggttcttgctctgttgcccaggctggagtgcagtggtgcagtcatggctcactgcaacctagaactcatgggctcaagtggtcctcccatctcagcttcccgggtagctgagactacaggcacacatcaccatgctctgttaaatttttttatttttattttttgtagagacaggttctcgccacgttgctcaggccttgaaattctgccctcaagggatccttccaccttgacctcccatagtgctggaattataggtgtgagccgctgcacccagcctggaaattacaatcttgaaagcagggattgggggttctttttatttaaaaaatttccatggaacctgtttgccagtctggtgaagcctgtggaccccttttcagaataatgttggtaaatgaataaaaagggaaccaaagaattacaaaggaaaccaattatgttaaaatagttgtcaaaatagtacaaaaatacaagcaagacatatgctttattatagcaacatccagcagtgggtcaggaggtgatcataattttgaagcaggggtgagtgtaaatgatagttcaagataactgcaactgtgaaatgaaatgaaaatatctattcatgtagtgggaaataaataaatttcatagatgctgctagtaccattgtggtttgttgcttagattcacggtgagaataaaggccaaatttcagaagatagtaaaagatgtatttttcttcccatgtaagtttagaccccctgaattctatccacacaccccagttaaggacctctgcttaaggggtttagcctttcagattatgaggaatgaattgcagggatataaactcccatttgcatcaagaaaattcagaaatacctaggcttcctcccctctttattctgatggggatgagaagggaaactatattaaaaatgagtcaaaatttaaaaatattatgactacctgcaatgaagatctccccctacccccaaaagagagggtacatgtggaattctttgacactttctaaatctccgagcacagtggccatttttggtactgattttaaaaactgggaaaccctagatttgtttatggtgtgtatctcccacccccacaacccacacacacatacctcccagtaattctctaagattaggcaagacagaagtatcccagatgaaggtctttaggattttctagacctttgttacagttcttcaaatgtttgtgtctttttttctcctctcctacccctcattccctcatcttttccccctccctgcccattctacctttaactgtaaaagttaggtgtctgatatattcatttgtcagcagcaaagtttgagaatgcctttaaaaatagatatgttagagggagtatgttggatagaaaggagaaatcttgtttatgctcaataaataacttacatttagaaccttccttcaatttttcctttgaaattctgtattctcatttcacttgaatgactctgcatggagcgtttaaaagtagatcaaacaaaaccctataaatatgttgagttcttttgggcattttgccaaaattagccttgcagggaaaagcagtgtgctttacgtattggattttctcctctgaaaatccagactccctctcctctggagagctagctgccagggctgggggaaagtcaagccagggacacattagggaagtgtccctggtatggcctgctgaggttgggttatttggattgagggttgtgctgaaaggccaaaaccaatgcctgggaccagcctgaagaaagatgaaaagcagagggacgtttagagacgtcactgattttatgttatgacgtgattcctttatctcactctgattggaagggaaggctggtgaaaaaaacattaacagagctgtcttttaacagattcctgaatgtaaagccaaatggaaaaaagggagagagtcaggtggaagtaagccccttggaaagtaggtctgtctccatcatcccaattttatacgtgagaaaaccgaggcagagagccacgcaggggttgcaatgctgggtgagttgggccgtttgtctcttctgtattgttaactcagggttctctattattattattattattgttattattattattattattattattattagttagaggtggggtctcactatgttgcccaagctggtcttgaactcctgggctcaagtgatcctcctgcctcagcctcccaaagtgctaggattacaggtgtgagccaccatgcctggccccagggttctcttttatgtgctttaatgctttaagtgaagaccacgtatccatgagcagtgaaatcagagcccctgcaccctttcacatggctaattcacatatcatttttataagatatagttgaggtggaggatgttgagttcttcatgctcatggcaccaaaattacagatgtggcttctaaagaaatatcagatgacaatgttaatgttaaaatatacatatacagctcctctttgcagaaactcagtttattcaatggatggcccctttgactattacgttggaagtagaaacttgatttgggggggtcagatgttaattgcccaaatttaagacagttttcagtgacttctttaaatgaggcattagactctgaagttcatagggctgaggagggcctggatcggggattttctagatatatggcacctggggtccacatagggatctagagtggtgcagtggcatcgccctaaccatcatgaggcagatgtgagtgagtcgaattggttgatacagatgtgcgtgaaagagctgagaggtgtcagggttgaaaagatggagacagacagcaaccgacactcacagataacaaaaacacaatggaaggaggacagtgctagagaaaagcaatggttgttaggagaacccagagaaggggcccccacggctgaatgaatgagtatgtatgtgtgtgtgtatgtatgtgttcccatgagtgaggggcgagctcggaagatggacaccacagggcccctccacctagtgagagatggctgtctgggctgtgtaggctggtggtgtctggccagggaagataaccttggcttggtcactgatggaatagtatgggcctcctcagggttctgtaacagcatctgatcagaataatgactaatgtgggctacagatgtggagccctgtctctgagctcacacctcctgctgtgttcgtagaccagccacaaccagttgtcattgggaggtccgaggccccttgtcattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtgatgtttttaaaaagtgattacagtatattacgtgctctttgtgaagacaaattgatattgtagaagcatttaaatgagtttctacccttcccccaatctgcctcccctgaagtatcactgttactttggggtatagccttccataccattttctgtgcttacacaagtgtgtccgtgtacatataccccctttctctcattcatttgtatctttttttgagacagtctcttactctgttgccctcattcatttaattgtattagaccttcataaattagttgaatgttgaatggattcatttatttattaatgaacatttgttgaatgtatactctgtgctaggttccgagttatcaggagtaactaaaatgctacatgctgcttagagttatgagtgtgtgtgtgtgtgtgtgtgtgtgtgtgtgtgtgtgtgtatttataaaattgggatcatagtatacatattacgtgatttagtcttttagtgtactatggacaccttttcacactgatacacgtagagctacttgttatatttaatggctgctggatataccttcccctcccagtagacatccaggtttcacatgtagatctctgtgcatatatgcatttgctattagaaacaatgctgccctgaaccttcttatacatatatctttgcctacttaaaccaaatgttttctgtcttttaaggggaccgaatataaaatcaaacatacgtcatttcttgttcatatatagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactagttctacattttctcttatatcctgccaagacttgggagaaaatgagcactggcatagctatacccacttgtcagatgccctctgcctttgaagtagcaggcaaatggatttcctgtgttctgcggtgcagagatgttgattatacacatccctgtgaaaatcaagcaggctcatctccagggaccacacaatgctggttaattaaatattatacatttccactgcaacagtccaggtacagccaagaggggtttgtaaagaaacacccacagggtccttttatttggagtgccattggcttctgaagtgtcctcctcttcctgtgagttgcattatgttgaaacaggatgacgagtggaaatgtttccagtaaagagtatgatgcaggggttctgcaagatcggtaaatctaccttctcttcccttgtactcggaatctactggacgtcccaagtaaaaaatgtgtgaatctatacatttagttaagtttgtattgttttctccatcctgagatagaaaacatggcttcttgcataaattgaagtttccaactcaagaacagcctttaaagaagctggcatgctgctcagtaactggggagttgctgccttccccccaccccctgagcccctggcacctagcagtgtttgttaatgaatcatagcagagacgtccatcttctccactctcctgccccaacccaggaacacatttccagagctagaaactacttactgcaactgttccaaaggtctgtgaaataaacatcacagcacagcagcattcacctgtgctatgtattaaatactattgtcagatatttagaagtctgagttctctcccttgtgggaaaagacaccgaatgtaggacctaaaataacctgatcctggaagagtcccattcgtttttggcctgatgctcttctttgggcaacagatctgactaggtgtctctggaccttggctgcacattagaatcacatggggatcttttaaaatccagatgcccaggctgcacctcagaccaatattgacatttgaatctctagaggtgggtccaggcattggtatttccccttaaaatttttaatcagaaaatattttaatgcacagaaaatttgaaacaatagtacagtgaacacccacctagatttaccaattattagcattttgtcacatttgctttctatctctatcctctatccaatctccacacatactctttttgattactttttttaatcattgggatttttggcgttttttttttttttttggagacaaggtctcactctgtcgcccaggctggagtgcagtggtgtgatcacagctcactgcagacttgacctccccaagctcggacaatcctcccaccttggcctctgtactagctgggaccacaagcacatgctgccatgccaagctaatttttcattttttatagagacgaagttttgccatgttgcccaggctggtcttgaactcctgggctcaagtgatcttcctgccttggcctcccaaagtgctgggattacaggtgtgagtcactgagcctggcctgatttttttccttaaacggtttgaaaataaattacaaacatcaggacacttcatccctaaatacttcagaatgtatctcctaagtatgaggacattctgctaggtaactgcgatagaattaacaactccggaaatgtaacattaacatgctattatctagaattagttcatattcaaatttccccagttttctcaatgtttttatagccttttaaaaatgcagaattcaattagagatcatacattatatttagttgtcatatgtctttactctttttaaatctagaataattctctagccttttaaatatcttttgtgatattgacttaagaaaaaaatatttctgtgcctagcttatttcacttaacataatgacctccagttccatccatgttgctgccaaagacaggatctcgttcttttttatggctgagtagtagtctattaggtatctataccacattttattttcttttttttaaataaattttatttttaatttttgtaggtacataggtgtatatatttatgggatacatgagatattttgatacgggaatgcagtgtgtaataatcacatcatggagaatggggtatccatcccctcaagcatttatcctttgtgttactaacaatccaattatagtcttttagtaatttgaaaatgtatgattaagttgttattgactatatcatcctgttgtgctatcaaatagtaggtcttattcattctttctaactatgttttttgtacccattaaccatccccatctcacccccgacctgctcccactacccttcctagcctctgataaccatccttctattctctatgtccattgggttcaattgtttggagttttagatcttacaaagtgagaacgtgcgatgtttgtctttcggtgcctggcttatttcacttaacataatgatctccagttccatccatgttgttgcagatgacaggatctcattctttctatggctgagtagcattccattgggtatatgtaccacagtttccttatccacttttctgttgatggacacttaagttgattgcatatctttgctactgtgaatagtgctgaggtaaacatgaagagctaaaaaggttgatctcgtggaggtagagagtagagaggttggttactggatacaaacatacagttagattgaaagaataagttctagtattcagtagcagagtagggtgactatagttgacaacaatgtgtcgtatatttcaaaatagctagaaaagaggaattgaaatgctccaaatacacagaaatgataaatgctcaaggtgatggacactcaaataccctgccttgttcactacacattctatgcatggaacaaaatatcacatgtaccccctaaaaatgtacaactattatatatgaataagaattttttttttttggctaggtgtgatgactcactcttgtaatcccagcactttgggaggctgaggcaggaggatcacttgagcccaggagttcgagaccagcctaagcaacatagcgagaccccatctttacaaaaaatacaaaaattagccagtgtggtagctcacatcggtagtcccagctacccaggaggctgaggtgggaggatcacttgagcctgggaggtcaaggctgcagtgagccaagatcacaccactgtactccagcctgggcaacagagtgagaccctgtctcaaaaaaaaaaagtttttaagaaaaaaatcagatgagttttttgtttgtttgttttgttttttttgagacagagtctcgctctgttatccagattggagtgcagtgggacaatcttggctcactgcagtctcctgggttcaagtgtttctcctgcctcagcctcccgagtagctgagactacaggagtgcgccaccatgcctggctaatttttgtatttttagtagagacagggtttcaccacattggccagatggtctcaaactcctggcctcaggtgatcctcctgcctcagcctcccaaagtgctgggattacaggcttgagcgaccatgcctgaccagatcagtttttgtaaacggctcctcattttaaatttgcatgattgtttcctcgtggttggatttaggtaaatgttgtggcagaagtattctataggtgatgttatagaagtattctataggtgacgatattctataggtccttctcagtgcagcctatcaggaggcacgtgatgtcaatttgtcctatgattagcaatgttaacttggatcacttgggtaaggctgtatctgccagctctcttcattccaaggggaccattttccttttgtaactgtggggagatactttgagatttggtaaatatcttaatccccaacaagctttcgcccagtggttttagcaaccgttgattcttcccagaatcaattattactatgatggttataaaatggctattgtctggatatttctatcatttctgtatttgtcaatgttcttttgttaaaaaaaagagaaaaaaggagctttcacttctcaccccataactatctatctgatcttctttagctagctgtctagctacctgttaaacatattaatatggactcatgaattttttaatgaatgtattgtaataaattccctcagtacataccgtattgtcccaactttggtcagtggaagccctgtctagctgactcctgtgtccttttgaaattatcccttaaatgtttgagtacttcatgaattttagcacaaccagatattttagtctcactttgtatcttctttgccgtaggcttagaagaagccatttttctatggagacctagttcctctggagctgctatttaggaaggcatcagtagttttgtgaaagctccctagtcgatttcaatatgcagcaaagaataagagacatagattagagtcttccaaggggagaccacctgttcccacaaggtgtttcttttcttttaatcacctgttatttgtggtgctgatttgttgctgagatttagattttcatgtgtgttactcaagagatagctttaaatgcaggtccctggccccaaccccaaagagtgagttcagtagttctgccttgcattttaacagtctggtgcaggtggtccccaggccatacctgtagaaaatgccagaagtaaccctggaaactgggaattaggggtttcttttgattttcctcttttgctttttatcagtggtttctaccttgcaatatgatttcagaatactgccacgttccccaggtatgtggtaaggatctaattgattaatttgatggattctttgaaaatatcagatgatttaaacccttgtagctttactcttgttccatcatggggaattggggatgtgaaaaaaagaggtggtggggtgggggtggggtgggaagctttataagtgttggaagttttcagttgacccaaagacttttttcatccaatacattatttgttgttattagtttattttcacggacactgaatgaattggcctagtaaagttttcacatgctgtaagatcctaggatgtaggctctaaaatatagttgtgtgtgctgttttggggactgggtcatgacaccgtagtcagtttctgctatttccttttctgagaaggcaattaattgcattgcctccccatccaaccagctttattttattaaatctggggcctgtagggcccaagtgcccagcagctgtaaggaaaagctcctgatttgtggtttttcccttcctggttccacctttcaaacaaataccatgttagtgcagctagtcccttctgtgatctcaagacccaggactgagaatgcttaagaacagtcagatgtgggagggagatagtgcttctggagttgcgttgcctggtttgaaatcctctggtaaaatacatgatctctatgtgcctccgaggtcttcttgtctgtaaaaagggggttagtaatctaccccagaggttcagtgtgaggattaaatggggtggcatatgtaaagtgcttagcagtctatggcacatagtaggtgctcaataaatgttactattttattaaacagtaaatggtcacaaatggaagggggccgtggggtctagtgagagagttgagggtgtgctgtctcagttatcattagatcggctattgtggtatcatagtgcttgtgatcaacgaacccttatttcacttaatacagttgttcccccttacccgtgggtgctacatttcaagacccctagtggatgcctgaaaccatgaatagtgccaagtcctatatatactatgtctttccctatacgtacatatctatgagaaagattaatttataaattaagcgcaggaagagattaacaccaataaataataataaaacactaataataaaatacaacactaacaatatactataataaaagttatgggaatgtgttctctttctctttctcaaaatatcttattgtactgtacttagccttcttatgatggtgtgagatgataaaatgcctacatgatgtaatgcagcgaggtgaatgatgtgggcattgtgacgtagcgtttggctactattgaccttctgatgatctatgagaatgaggatcatctgttttgagtgatcctggatcgtggagtcacaacgctgtctgtggttagatgtgaggagcagacagtgtcagtgactcaggggcagggaacatccgtagcgtggagacgctggacaaatggatgattcacatcccggacaggatggagcaggatggcatgaggtttcatcacactactgagaatgacatgcaattgaaaagttatgaattgtttatttctggaatattccatttaatatttttggaccttaggtggccacaggtaactgaaactgcagaaagtggaactgttgataaggggggactactgtaaaaattccactcccagttcatttggacatgaaggtggtggctcaaactaaggaattccaaacctcaggcataggcaagtcataagtttttttcctttagtttatgtgagctattgaaatgaggtggcattgtcatctccttacctctttaaggaaggtcaagactcactagtaaacaccagtgaaattccaggagaggaaaaaaatgacaaatgactttcttagacttccttaagtttaagatggatggatgcaactgaaatacaatttctcccaacttcaagcatcccccttgaactgggttgtaggtcaggtggtactggcaaacaaattcaaatcagtgacaggctatagttgaggcctcgaaaagcagcattccaggagtttggtgttctctgtaatgagaggtccatggcagagacctaagtgacgtggtacagtgttgcaggaagaagttgagtacagattgcagagagtttggcacaaaatgtgaattgaattagtttatccagcactagagagagaactatgaacttaggctaaggaaatgctgccacttactagcttggtgacctggggtaagtcattgagtcctggattcctcatttgcaaaatgattgcccattctggcttttattttttaactcatgtggttggcaggaggagagggtgatggatatcagaagggtttgtgagctatcccagtgcgagggcgaatgattgtgcttggcatcaggtcacgtgatctttaccaccagccacctctgggtccctcccctgtgccctctgtagggcttactctttggcatgttggcagtgagctttgtaggactttatgctaccaaaacagtaacagtcatgaggctggactagcctggcagagagaaagtagcgaagacatcattcttctgacaccaggcaggcctttatggaagtccgatgcggggatttggtttaagagcagtctcattattctgtttcaggtcctacatccattgggttagtcttttctctaagaatagatcactctctcctttgccatttgtgcagtgttggattagatgctactttttacagagggttttttgaacatatgaacttacatacaactgtaagttttatggcttcagctaacactagatcttcagatggtgttattttaagtcactttggtcaggactttgacttctgtggttgtgagtgttggttttcagacgtttgtcatttcacttgtttcatgttcagatttgtgtctgcagagtttgcttttaacataacatccagcaaatgaaagccctttaaagattggtagtagaacttcattttaagaagcatctatggggccagtggagtcgcaggggtcaggagtgggatgccaagattgccttgtaatctagactttctttgctagaatgagaaatccatatcctttatggtacagggtacttgatttgccttccattgtatgggaagccatggtatagtggtggcgttctttgcatcggaatacccattcctcctgactttcctccttggaaaagcaagttggagtgggccctctgtcctagggagagccaagccctccttggggttgcactactcagcctgctgacagtgccatcagcatctaggaattgccctggaaatgctgtgtttgttcctaagacccagaggcttgtaattttgcacaaaggggtggagagtatttgtggagtcaccaaagatgtgattagacaagatatcgattctgaacttctgccctcttccttctattcaactctgttcttgcttagtgaggtacaggcaagaaaaatggaacagagagaactaggctgccggcttttgaaacatattgatcagggcacacatccgatgtagcacagagaccttcccctttatatgatgtcatcctgcattggggccttaatgtgccctgtgatcacctctgcatggacttcctttctcagagaaaagattagagaagaaaaagaatccctgtaggcagtgctaaaaaataatttaagcatttctaaatgtgtttctttgaagtcattgatccctttggttttctaggccatgcagtggcatgaaggaatggtgtgaggcggtcagccatgaacgacaaacttctgagcaatgtcggtctcacttcctacctcccatccacctccctggcttgggcctccactgctgtctgtctgtctgtctgtctgtctgtctgtctgtctgtctcaccctcacccccatacacgttctttctccacatagtgcacatctgtggtgtggatatgctgtggacagttgtgtctgtacttgaaccagctctaagccagggtctcccagataggacatgctgggtgagtgagatgttgtaaccctgagtgtcctctggttgagtgaagtgtggccctggctcttatcttgatttgtctggcttggttctgcgtaagtagctggggatcctgttaatggatcccctgggacagagggaagaggacagaagtagatttgttgaatcctgtgggggtgtttgaaatggtaccaagagcaggctgaaatctaatcagccttcacttatcaggcttgagttcccgtatgttgaaagggtgacgattagtaagaaaaaggccaggatactttatctttcctttgcacatttagaaaaatcccctctgccttgctagcattagaagcagaccattcttttttctctaccacatcacatcagcttccattaaaaatcaacagcagcaaatacaaagccccatctatggaaaaccgtttaaggcaacactgtgctccagtgcttcaggggtggggtatttgccttctgcaccaatggatcggtttctcatatccatgcctttctgacccagcagcttttaaaagaccaagaagcattgctctgctttctactgcctctctctaagagaccagggctgccgtgcctcaagccatgtcccagagagcatatttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaat

SEQ ID NO: 3219 - DNA, 353636 bp, human
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatgggtgagtgggggccgcccgcgtccgggcgtccacttcagccttgagggcggcgcgccagtcccagaaccgcggagcccgggagggcgccccgggggcagggtccggacgggggacaccgcggtgggcgccctcgcctgcctcgcgcacccccattcactcccacttgcgcccgtgtgcccgccgagcccgcgcgcggcgccgacgggaacccgcgggggcctgagcagacgatcacgggggctggccccgggcggctcgggctgagggatgcagggggtgtggttggtttttcgggtgggcggggagagttttgtcttggccatttttgcacccgagcgcgccctcctctgcgctgcggacacgggcacccggacctggtgggctccggccctgcgcggggctgctggtgtcttcctggtcctgtctcgggggaagctggaacctcggggtcttggagggggctgggttgcctttgctgggggttgacaggggttggggggtggggcgggaaacgccccagttcctggtctggctcgcagtcccggggtccagagcacctgacgctcctctccttgcgccccccttcctcccggccccgaccctttcgctgctgccttcctccagcctggcgagctctctgctccgtgatgctaaaaggccacttcccatactgtcctttaagtcttcagggtctgggacctggaaatggtgatccggtctttgatttactgagtaaacatcagttcgaagtagccaactaacctttgaaccccctgggtcccatttgatttagaccccggagcattggaaccaccttgctgcccagagaagctgccactttattggcaaggcacttatgattacttgggctattaaatgtttggtctacccaggtaatgttcttgctgacagccagcttctgtttttcagcctctggcagattatttttggatgttcctaggccaggcataggaaggctgcagataataataaatcataataaagtgagacctttctgtgttcaggtaataggattccagtacactagtcaggatgttcagaaagcctgaaggattggaaaagaggaggtttaacccagtccgttgttgacaggcaaagttaaaatcccatttgtggtcatttgccaaaaaaggttttccttttctaagtagtggtgatctgttgtccccttggcttaaatgtcacttttttcacagtgcccttctctcccacctgtagtctaaattggttcctgttccattttctcatacaacacctttttttttcgtagcagtattacatatttgtgcgtaacagttatctcctctactgtaagctctgtgaccatagggacagcacagtgttgcatagtttgctcagcacttttggtgtgtggcacagagcaggacctaaatatttgttgaatgaatgaatgaggggcatgaaatcctcctcctctgctggggacagaacacttagctcactcttgttttgctttggcccataagatgatttagttcattggcagaagtatatactttaaaccttacaggccactttagtaatgggttaatttctcccgaggtaaccaaaaattctgttttgatcacctttcattttgggtgggtcaccgagagggttatgcacaaaaagaagttaatccaaatgtcttctcccatggccagactgtgctttctgtatctcaatgagaaggggactgagtctcatttaagaagaatcagacctatttttcagatttgaactgttttcattcttcagaacttcctacgaaaaatagagtgctcctgtagtttttagtccttttgtacttaatctttactgcaaccattattgcagggggagggggcatcgattttcatttatttcaggagttaatacttagaggtgataatgtcaaaacgaatgtaatttaattcatgtttatagtgggatttaaggtgcttatagtagtttgtggctaaaaatcacctgctcttttgaaagcatctccagcagtatatttgtaatgaagtgcagttatttaacggttcattctgtatgtcttccaatggagtgatctaatgggctgaggttgtgtgtatgcagacagaggcccaccctttcccccaagtctctggttttcagatttatccagtttatcaatttgatgcaattttattcttttttaagagggagggtctcgctgtgttgcccaggatggatttgaactcctggactccagatcttcccaagtagctgggactgcacgctcacaccactgtgcctgattctgatacacttatattcttacctggcctgataatgagttttctcttgatggataacatagtaaaactgtatcttatatttcgttttctgaaaaataacagaaaagaaccaaatccctaaccctgaagtgaagctggttagttgcaacatggcctcttataaaagcccatcagaatgtgccctctgaacttgctaggagatgcatgcctacagtgccagacacagagaaagcctcttataattacaattaaacagatattatggtgacccaaatctgtgagtagtgaagggtttgcaagcccacaaatgatttctgtttaattccagagtaacaacaaagtttggatagcctttggcaatgtatttattgtattggcggtagactgctgtatgctaaactaaagctaaaatgaacataatgtgttggtctgtacaaatgtcttgagttagaaatggaagaaaaggctcccaccttaattgtacataagctttacccacttctatccatcttggcacgagcaaaagcttgctgtggctctggttacacaaaccttggtggtttcttctcttactacttcagttcttttggcgttactgacattctctcatcaactcttgagtttgtagttgtttttaatgtattttgcatacagcagtatttgttcatctatccatccatccatccatccaatgtttgttgatcttctttgcataggcactgtgctaagaacaggtgcagaacagagacatgacactttgggcttctcagtctaatgaaggctgacttgaatgcaattctcatggcagtatgtagctgaaagccatagtagagcgcatgaaagatgagtggagaaggccaatctgacttagcctggagagtgcccaggacagtgtcttagaggagattgtgtttgagcagaaatctggttgagtatgagtcatcactgccctccagccacacctggttcttgtggcagagactgaaaacgagcaccgtgggaaccgcggggcatctcagtaagatggtacaaggaaggatgacttagagggcttgcacctgtgtcaggtggcttgagggcgtgtttaaggaagctgggcattactttggattggatgctaccagggggaatttgtgattgggtattttaacaaatgttctctaggagcagggaacattggaggcaggccacagctatggttggtaaagcagcagcagtcatttgcattatccaggattgggggatatttggtcatgtgtgtggtttggacaaggtgcatgttttgtccgtgttcagacatgattaatgtgtggtcttgttttcatcttattccatcctggtcgcagagtggccttgtctgatgttggttttctagggaattgtttctgttcaacaggacaccctggcccagctgtgggtgcctggccagctcccagccagaagaactgctctttctccgagttaactatgtgacaggcaggggcagggaatcggaggcagtgggggaggaaaatggctttctaggtatatctgtggctacttcatatcaaccaggtatagcctggactgttgttcaatgctaagcacgatggacatctgaaatgctatactaagggaagagagagtgacagagaaagagcaagctgctgagaaccatgaagtcagtgctaatgggaaagacgcagaacaggaaaatagcccaaatacttagtgttagagaaggagagcctctaatgcagcgcttctcagagggtggccccaggccagtagcacagcctcccctgcaacccgttagagatacagattctctggcttcattccagcagacctcctgaatcaggaatgctggggatggggcccagcaatctgcattttcatgagtcctccaggtggttctgatcatagtccagtgtagaacccctccttgccttacagttgagaaagctgacatccggagctcgtggttcactggggtacacaaggcactctgttcataagactattataagtcttatgttataagtactgttataagtgactcattaccttagaggagaaagacatactcctacttcaaaacacacttcttgtgttaagacagtacagtgtggattcttccacgaatccagtccaacccagacctccaacacctaggcattagtgacactaggcagccgatctcagtgttagtctctgagacttttaccagagtatcacacaggcacttcccagcatcctttaccctccatcctctttaaaggggactttaagttacactgtttgcattattccagggtgtaatatttgttcatgattttctatacctggtacctgtattcgtttctgattgctgctgtacctaccacagacttagtgcctggagacatcacatgtttatcatccgtcactgggcgacaatcacgaagtcagcagagctgcattccttctggaggctgtaggagggaatccctttccttgccttttccagcttccagaattggcattcctttgcttgtggcctcttcctctctccaaagccagcaacggctgggcagctctctctcccatcacatcattgttactgactcttctgcccctcttttccatgtgtatggactcctgtgatgacattgggtccacctggatattccaggctcatctcctcatctccaggtcagctgatcagtaagtttaactcccctttgccttgtaacctaatattcacacatcctgggctttaggatgtgggcatctgggggcggggagggaatgttattctgaccactacactgccctgtggtggacctgacgtttcctggtttctcttggataactgtgtgttcatagtcaactgccctgtccctccttgggaagattccatctttggttctatttagatttttacagtttattaataaagccgccttaaagttacatcttgcattcacctttcctcttcactgctgtttttttgagacagcttgtcccactcttcccctttcctcacatagcctgccctacacctaccaggactctggcactgccttgattgtgttctagaaactgatcatgctgaggttatcctgaatgatccttctccaatcacgaagtacatggtctcaggcctcaccatgtttgacttcactgaagcttgagattgaagactggaagtctttgtcttctagaacaccctattttttcctgatttctcctacagtcctcccttcttttcttccacccctgtccacctgtggaatgctgtcatctctggtccccttatgtttagtgtgtccttgagtgattgcagccactttgccaattcaggtgtcgcctattgacgatgcccacatctgtccccagtcttggtctctgttctgagctcaggacccacccactataagcaccacaagggcaggaacctcgtcagtttggtcattgtgttcctgtgcctggtacactgtaagcctaagattaacattggttgagctgattatcattggtatcctctcctagctaacttcacccaggtgtgtcttagacgcctcagactgagcatgttgcaaactaagcacagcatttctcctctgtaatgcctgccctgcctctttttacttcccatttcattgagggtatcaccatctttcctgtcacttccacagggacgctgctattgttccttgcctcttgttccttcccctttccctgccccttctgatgtacagtcaagccctaagtggctctggaattgaccctatgtgtctacccttctgcaaatgctttagatcctgaatgccttagtgaagccttcgtgaagctcggcagccaccaatgctttcgcttattctaagctcattcaggtctctgagactttgcccacgtatttcccttcatggggaacagatgtcactctctcctctgccttgtagactccctgtatcagtttcctattgctgcagtaacaaatcactgtgaacctagtggcttgaaacagcacaaatgtgtaatcttatagttctagaggtcggaagttcaaaatggatcttaccgggtcgatatcaaggtgtcagcagggttgcgttctttctggaggaattcatttccctgccttgcccggcttctagaggctgcctgcagtgcctttacctccttcactcgtaccccagccctccaacctctgcttcagtcctggcatctcctatctttcaccgagccacctgcctgccttttatgaggaccattgtttgacactgggcccacctggataatccaggatcccctccccttctcaggatgcctggtgaatcacacctgcaaagttcctgttgccatggaagggaacatagtcacaggttctggggattaggatatggccatctttgggaagtcattgttcagcctcccacaccgcttgtgcatctgtgggagcctgctccaaaggtgtgctgtaccatactttgtttaaaacattttttatttttaatttttgtgggtccatagcaggtgtataaagttgtggggtacatgagatgttttgatacaggcatgcaatgtaaagtgatacaacatttcctcttgtattaagtctccatctccaactggatctgctcagctccattgccctggcacattgcctggcatacagtaagtgccatatgttaatgaatgaacatgtaaccctttcacccaaatacggttacaacttgcaattctccacgactatggaccaccaggagtgagtgtgcaattctgtaaagtcccctgggcagagcatgttgacaaggtctgtttgctgacagttcctggtggcccacactgtagtgggtgagaagggtgatgccacatgtattacatggctttaacaaagaactgcacattttaagatagaaaattctctctggcagtggttctgaactgggggcaattctccccaccagggggacacagcactatctggagacacttttggttgtcacagctggtggcgggggtcaggggagtggagagtcattctactggcatctactaggtggaggtcaggggtgctgctaaacatcctacgatgcacaggccagccgccccccgcaccaccacaacaaagagttatctgaccccaaatgtcagtcatgctgaggttaaggaagcctgctctgggggaaccccgggggcttattaacacagatggctggagcaccatttccttacttcattatcagtccttctggaacataaggctttgtatgtaaccacagtcttcgttttatgcacgaacctacaagtcactagagaacaggactctttgggactttcaccattttgttctttgaatggagagtgtcttaacacaactcttgcctctcttccgttgatacctaggtagttaagctggggagaggcaagggctttggggcacgaagttgttaaacttgcttctggtagtgtttggcccctgtaatgttttgtctttctattgggatgtgcttttatgtggggggacaggcgatgggtcctctgctactcacatattggtccctggcattgaagtgctggaaggagccttggcagtcatggcccatgacatcagatgatgagactgagcctcagagaggcagagtgacaatggtcccctagtggtagaacccaactgccttccagtatggaagaaccagccccgcccaatttctgtaggtgctcagaaaatgtcaggctcctgcttcccctcgtgaggctcttgctacagtctctttccgtagtaagttttttattttttattttttgagacagggtctcactctgttgctcaggctggagtgcagtggcgcaatcaaggctcactgcagcctcgacctcccaggctcaagcgatcctcccacctcagccacccaagtaggtgggactacatgtgcgtgccaccacgcccagctaatttttgtatttttttgtagagatggggcttcgccatgttgcccaggctggtctcgaactcctgggctcaagtgatccacctgccttggcttcccaaagcattgggattaggcatgagccatcacaccagggtgtaagttttttttaaacagatttattgatgtataatttgcataccatacaatttatccatttaaggtgtgcaattcaatgggttttggtacattattaattttatgctaaaacatgtaacaaaatttgcaattttcaccacttttaagtgtatagttatactgggtatattcacaatgctttgcaaccatcaccactatctagttccaaaactttctttttttaaaatcacccctccctagtaagtttctaacttgaaggtcagaatccatgtcccctgggggttcctggaccagccagccaatttggagaacacttggaagcccaaggatcccagttgagattccaaaggaagataggaaaagggaaagcgtggctttttgtgtgtgtgtgtgtttttggttgatatttccttgggaggccctttattttctctctctctctctctctctctctctcacacacacacacacacacacacacacacacacaaattagccaggcgtggtggcacatacctgtagtcctagctactcaggaggctggggcaggagaatcacttgaacctgggagcaggaggctacagtgagccgacatcgcaccactgcactccagtctgggcaacagagtgagaccgtgtctcaaggaaaaaaaaaaaaaaaaggtctacatcatgggagaaaacactgcagtgccaaacagatccctcgaattcacacacatggttgatatcattccacgtttcttcacttaaattccttcagctggcaaaggtccaccagcaacctgtgatcatgagcacttggttttcaacttgatcattatcttatggataaatatcttgcaggcagttctgtagttttcattaggggatgcttaaggcaaaaggtagctcatgggtcttaactctgtggtcaactgtgcttatatttagccttacaaagaaaaaacactaataacaaaaatcctgtgatacttgtcctaacggaatactatccagttggcaagaaaagaccagaaaaggcctctgcttacttcctttctgtggccacggaagtggtgggggcactgctggaggctggtccatctccaggtgtgggtgacagagtggcaagatgaagtgcagttcagttcatactgttatttctatcttggataaaatactataaacatttcaatgcttattaatgactcatttggcataataaatttaagtccttgagcacccaagtacagcatgtatagacagtttaaacaaccatctccttacacttgagcttcttaccagccagtatgcaaacaccagcccttgtgtttttgccagatttttctggactgttctagacttagaagacttggggccatgttctaggtctggtcctctggggctgcaccagttttagccatcacatgttacctccccatgtgaaaagtctttaattagcttagtgtcctgtctaattattccagctagttcttaggtttgtgcctggagctagacggagacgcttggccctcattttggatgaagactgggaaaggccattcttgctctgctgccccctcctcttagccagcatcttcatggacctcaattttcttcaccagggtgttctgggtgctgtcttttgatgagcattttacataatagcttctcaaattcacttgacagaagtgacttcgtaaatgaactttgcctttctcctgttttgatcatcaaaacaaaaccagcaaaaacatctcttcacaacttgaccgaaatgggacagttttaaaccacttagccagtgatttctaattacccctttgttctcaacaaactattagatggcaaagagaggtgtcaactcaaatacagtaggtcaatgagctcatctgtgatccatgaagcaggatggacagagtaagtgtttgttaattgatggtgatttttttaaagcttaattgctgcttttggctgtcaggaaacaaatgaaagtaattggcttgcggagggtggattgtggggggaaaagtgaggtggaagatttcaccaattgaagaaaaaattggaaagggggaagcagttcacactgtcttcatctgttttctggggcataatgactacagctgcttgcttgagacatttttaaagttagtttttggaataggttatatatccccaggattcgaaattcaaaaggtgaaaaagtgtttacgggaaaaagtctccctcccatctctgtccttcagctatgcagtgaccctccccataggctgctgctattttgtttctcaagttttcttccagggagctttcatatgtataccaacacagaggcatttctgttattttcccctccttttttaacgtcctgattaattgatgatgggtgaacttctgtctagctggggattttctcccccccggagatgtgcattggaacgctatgcctagtccttccatctagttttgatggagggataggtggacttcggaaaagttctccaggagactgctctattgtcctgaggctcagctgatctgggttattaattgacagaaactttgtcctggatcttaacccatctaggtgttttttttgtttgtttgtttttgttttcttgacagagtctcactctgttgcccagcctggagtgcagtggtgtgatctccgctcactgcaacctgtgtctcccgggttcaagcgattctcctgcctcggcctcccgagtagctgggattacaggcatctgccactatgcccagctaatttttttgtatttttagtggagatggggtttcaccatgttggccaggctggtctggaactcccgacctcaggtgatctgtctacctcagcctcccaaagcgctaggattacaggcgtgagccaccacgcccggccttaacccatctgggttttgaactcaggaacagtcttcccactttcatgttgtatatatagtaaggactttcttcaaatgatagaagccaagcagggcccgctaacctgagcaaaagggatgcttattctggggccacagggacctctcatgcaacccaagggtgcctgctggaggagccggaccccaagaagcagcagctggagctaggtgtgggccagctgcccagtgtgccctctggccatgcttcctccctgtcccctttcttctgtgtgacttgttcatggggcacatgccacagttccaaatgcctgttaagtgtgacttgatttggtcccagttccacatttttgttagtgagactgagcccaccggagcttctgtctcctcccacctccaccctccatatacacaggtggctgctccatgcccacatccatggtgggcgggaggtgctcagttccagtcctggtgtaaatgttgaaggagggcgcatggaggacccaaatgaagccctgccctgtggaggagtgggtgctacggggctgccctcgggccaggcactctcagtgaggatgctagaccgcctgccagtgttggcattcattttccctgccctcctcttgacaaaggagtgactgatgtgaggccgtgtggcctcttctgtgctctagccatccaggatgttcattccatcctcacagagtcccttctatgaggctccctgaggaagggcccttgtcggagccgagaacagttgtgcttcagagtaatggggctattttaatcctttgagctcctgaactgtgtgactaagctccatgtcacctattgagttggcggccgttaaaaagtgtgtctgtgcctctgggggcccttggatgggttggtgatagcatgccatgggggaagggtacagttgtgacatcgtctggcgcttttagggaacctgtgggtttttaaatggaggaagagatgtagacattgtaaaaaacagccaccgcctgacgagttaacccctgaggtagagatgcgctccagaaagcgggcagggggctctcgccctaatgcctatctcctccctcctgccttctccccctctttttctcctctctctccccctaccttttctctctctgctctttcttcatcccctcaccctttctctcatccctcactcctcttcaccctgtctccctcactttctctcatccagatccatctcccctacgctctttgtccccgcatctctctcccattcccctgcaccccctctccccttccaccctcttttccacaccccttctccccacaccttctctttccctcttagtctctctccccgcatcctcactgtccacccccagcctcctgaccctccccacttctgctctcccttcctctcagcccctctgtgttttgcccctttcttcccagcccgttcctcttattttctctcttcctcacccctcctctcctggcccctgtgtcttacccttctcattgcccacatcccttctccactgcccccttctccacacttcctctcctgttcttactaagcccttcttcctttcttcttccccctcctgcctctcttctctcacccctcaacacctccacacccccccactttgcccccccaactcttcctctcctctctcccatcctctcatctgcccccaagcccccttttctgtctctctgcccacttctttctcccccgaccccagttctctccccggaaccccactctggccccagtgcccactctccctcaacccctcttctctcttgcacttcctcctccttcccacattctcccatttcttccttcaaacccagtattgctgcgtgcctcagattttcaatcccacagggcaggaagagccagggacagggttactggccttctccatcccacagccagccatgggtccctactctagaataactgtgatttttattttagtgtacttcttttagagttttatatatatatatatatatttttttttttttttttttttgagatggactctcactctgttgccccggctggagtgcaatggcatgatcttggctcactgcaacctctacctccccagttcaagggatccccccgcctcagcctcccgagtagctgggattacaggcgcacaccaccatgcctggctaatttttgtatttttagcagggacagggtttcattgtgttatccaggctggtctcgaactcctggcctcaagtgatccacccacctcagcctcccaaagtgctgggattacaggtgtgagccactgtgcctggcactatttcttttttcttatgaactcctcttactatcattcccaaatattttggtgtatttctttttaggttttctttatttttatttttattttttttgatagagtcttgctctatcccccaggctggagtgcagtggcatgatctcggctcactgcaacctctgcctcctgggttcaaacgattctcctgccttagcctctcgagtagctgggattacaggtgcctgccacctcgcccggctaattttttgcatttttagtagagacagggtctcaccatgttagccaggctggtctcaaactcctgacctcgggtgatccacccaccttggcctcccaaagtgctgagattacaggtgtgagctaccatgcccagccagggtttttactattaatatatacttgttgctatatgtacatgtattttatatatacatgtatatatatgtatatgtatatatatatatatatatatacatatatatatatatatgtccttgttttttccacttcatagtcatctttgaagccagtgtttttagtagctgaatatttgagttcatgcatcttaatttatgtaactatttccctgtcatttgagcatttaggtagcttctatgatcttgatattatatagacgaggatgtgatggacatatgtcccctttctatcctgtaaggaaatcacactgtaggcagtgtggcattttatatccattctttatctccatagatgcccaaatgactggactggcccctgatgatgagaaggaagaagagttcagtccaagggaattggcacatgggaattggcagggtacttgtcctccatgtgtttgctttcagttttagttctagaaactctgtgttcatatggcttatcatcccttttatatgtgctctgtgtgtgtgtgtgtgtgtgtgtgtgtgtgtgagagagagagagagagagagaagagagatggagacagatcaactgatacttcttttttttgagacagtcttgctctgtcgcccaggctggagtgcagtggtgcgatctcggctcactgcaagctccgcctcccgggttcacgccattctcctgcctcagcctcccgagtagctgggactacaggcgcccgccaccatgtccagctaattttttgtattttttttttagcagagatgaggtttcaccgtgttagccaggatggtctctatctcctgacctcgtgatccgcccgcctcggcctcccaaagtactgggattacaggcgtgagctaccgcacccggccccaactgatacttctaaaagcaactgcatgtgggcttttatgttccacagcactgtccctatttcactgcaccactgtggggcaattaatcctggtctcgagttcaggtgtaagattagaggatacacagtgaaaggtgaaatccttgggggtttggttcctttgttttctctcccgctttttgccattctttttctttctttctttctttctttctttttttttttttttttttttgagatgaagtttcactcttgttgtccaggctggagtgcaatggcgcgatctcagctcactgcaacctccacctcctgggttcaagcgattctcccgcctcagcctcctaagtagctgggattacagccatgcgtcaccatgcccggctaattattgtatttttagtagagacagggtttcaccatattggccaggatggtctcgaactcctgacctcaggggatccacccacctcagcctcccaaagtgctgggattacaggcgtgagccaccgtgcccggccaccattcttttacctgactgatatttaagggaattttgtttcccagaaccatagggaaaactgtgtcctgaaggccctgagccatccatgtgacttcatgtttggctgagataggggtccaagtcccttgctggcaagggaaaggtcgtggctgtaataatccccttgtggtttctagcttagctttgtgtcatcatgcactcctctgaaaaaattgtgctcttagctttaaagggcaccacgtaagggtggctagaacccccaggagccaggctggatgaaccatctcaacgccttggcctttttaattcatcactttcagtaatggacaggattgtggaaagtattcattcttcagccaccaagtgtacgtcaaatgtcagctcatgtacctgttaaaaaaataagttgaatatttatgatgccatctcaggggcaagtttcagtgaaagttctaaagttcatgataataaatgttagaaagcattggtgctaatatgtaccatatactttatccctttgttaccttttcaaattgtgaacataacctgacttgaatttgtaggacaaacaaaacagttgactcaatactgctgtgtattggaattcaattaaattctagaagtgtttattgagtgcctgttaagcataagatctgataaccaggggaactcctcaaacatatctagagtttccctcaattgttcatttttcttaactttcatttccctaattgggtgaagattgtgatgtggtcattttatgaatcgcccaacaaaataagcagttaaaccaaagggtgtttgtttgagaaagttctatttatccagaaagaaggaaagatataaattttagcaaaacacatcaaattagaagacagctttgtgagatagaaaaatgtctagtcagtctctgaaactccctcctcactggtagtttagagagaaacaaaacagaatggggtttctcaaatgagtgctaaagttcccctcacaaggaaaacatttcccaataattcctgctttgccttaaacccactaccatgaagatcagcagtaacaggagacacggcggtgtgcttcggccgtgaggttgttgcttggtgatgtgacaggcacatactgcttgctctggtgcggtcttttgtgttcacttgcttatcccatctcttttctctcttcaaaccactgtgagaatcccttcacacagttctctctgaggccttctcatgtggtgctacacaataaaatcagttctggaagctgatatgatagttgatgtcatgtctatgacatcaaacatcattataaaatgtatagtagtgggctgggcatggtggctcacgcttctaatcccagcactttggtaggacaaggtcagcggatcacgtgagcccaggagttcgagaccagcctgggcaacatggcgataccctgtctctatttaaaaaatacagaaaattagccaggcatggcggcatatgcctgtagtcctagccacccaggacactgaggtgggaggatcacctgagcctggcaggttgaggctgcagtgagccatgatcgtgccactgcactccagcctgggcaacagagtgagaccccagctcagaaaaaaaaaaaaagaaatgtgtagttgtggactcatctcttgatgtaagaactaaaacactgctccagctctgtcccctccctcctctttccctagaggaagcaaccaccctaagtctttttaaaatcatctttcttcttttttaagaaataattttatcatttccatatgtatctcttaaaaacaaacatattgtctggttttgcttgtttttagttttataaaactgggaccgaaactgcagagacttgtgatttgcttgttgtctctgattttgcagttcatgtgtttttcctgtctggtattccattgtttgaacatgccactgtatacttaccctttctccccgatggacttttgctttgcttccagttttttgctgctatgtacagacttcccatcaccatttgaatgaatgtctctggtgtatgtgtgaagtgtatttttttaaatgtgcatagcaaggagtggttttgctgggttttaagttgctggatttccaaagtgttgtgccagtatatgttctcaagaactgagtgaatgaacaaactaatgaatgaagaagataacatattcatggaaggagagagtatatgaatattcagctttagaagagaatgcctaattgattttcaaaatatgtgttcctagagtgtaaacatctctgctactccctgttctcgccaatatttggtatcccagatatattgggatataggctaaactgccatcacagagaccccaagacagcatagctgtttccttctcaggctactgcctcctgaccactggactggtcagggtgagtgaattgctttgctcagattccttctctcttgtggacatggtcggagctggctcaccagcactgtgtccacctttcagcccatggcagagggaagtagacggggagtagcttctcttcgttaaggacatgacatggaaactgcttacatcacttccacccacaccccattgcaaagaacttagctacagtctcacacccagctgcaggtgagtctgaggaaacaggctccagctgtgtaaccatgtgcccagcaaaatctgaaggcagaggagtattaatttcctattcctgctgtaataaattaccacaaatgtaatggctgcaaacagcataatttattgtattctagtttgtgaaatcagaagtccagaatgggtgggcagggctgagtgccttctggaggctctaggggaggattcctttccttaccttttgcagcttctagaggtcaactgcatgccttggcttctggcctcttcctcacatcaccctgacccctcctcccttcatctcatttccttttccggctcttccatcttttaaagatccgtgtgattacactgggatcagccagttaatccaggatactgtcctcatgtcaagatccttaatcaaatctgtgaagtccctttagccactttaggtggcatattcacaggttcggggaattagggcatggacatactttgtggggattggggagcattattctgtctaccgtaggggaagggatgggttctacagacagtccctgacttataatgggttgattgaatggttttctgattttacagtggtggaaaaatgacatgcattcagcacattcctcatcatgtccccataaacccatcgtgagttgaaaatatcctaagtcaaaagtgcatttacaacttaggatattttcaactcacgatgggtttatgcagatgtagccctgtggttagttgagaagcatctgtattttttaaaagaggaaggggataatgggtactagagagaatgatcagtttctgccatatcataccatcgcatttttgccaatcacatggctgtggatatattttaagtgttaagttgtcagaactggtgaatttgctgaagagaggactttgttttctgatactttgtgattgtcgggattcaaatgttgaagtaatcctaaaaaacaaagcatatttttgaggtctttctcatgagtgacaatttcatccatcagtcttctgtttgccacagtccttttgcggagggcattcccatccactgttgtacttgtagcttcctcagcgaagctaacagagcagctagcatccctaggattaaatgacaaggtgcgtattaagatcccggcgcacagtaggggcccagatgtgttacaaataaacaataacaaaagcccacactagcacatcgtggccagagccgccttgtgtgcaataatcacctcatcatacattgcatgcacatagtaggtagacaaatcaaaccctcctttcctaataccctctggccctccagcttgctgtggactggacgtttgcatccccctcctattcattcctgtgttgcagccctaatccctcatgttgtgttatttggagatggggtctttgggaagtcattacaggtccctactcctttaggcagctcgatttagaagtctttttcttttttctttcatcaatttttttttctttcatcagtcactttcttctgataatgggggaggttaagtcgctaatttgtcaaatttatgtgcactcatttttgtatataagataggacaaactttctgtggtgataacttaggagtctgcaggggccagcaagactcatttgtcctttcctggatccagcagcaccatcctcggccccttttcattgcctccctgggcttcactaagactgtgcttggacccttccttccttccctccatgttgtcctaggccctgtcttgagaaatcttggctcttagcctggagctgacaaattcttgcttaggaggtggaagagaatcgcatgtctgactaaaataattcatacacactgcagttgcaatttcactttcctggggtttataaacaggaagacaccaccaattggggatgagttatttatttttgaggggggttcgtgagacatcttatttatctttgttttacttggtctgctggaaaatgcaaggaaatccgatttgttgtagccagacataattccctcttccctttcctccctccccacccctaacttggctgcttcctgaagcacaggagaagggtcaccacttgaggagaaggcacatgctggttcaggaagccccagtgggttcctgcaaggactccaaaaattatgctctgtgagcactagtttccctggcgcccaggccaagaccacagccttctcaggtcttcttgtctatgccggtatcactatgcctggcacagtgtctcaccaacaggcagcgaaagaaaaattttgttgaaagagtgaaaacaacatgtgactttaaagccagagcctcattttccccaaccagttcagaaatttaatgggatcgcatattgacttctgctcgagtgcatgttggctatggttgaggcgaccgagaaagccagcactactcagttttccctgctcttggccttgtcgtgttgtaaggtctgtttacgtttggatagtatttctctcaagaggcctaaaatataggtaaaatcatcagtgacgccatccatgggagaattttggcaacacaacagcatttgtgcctagaccacttctgctgtatgtatgagaatcttcctgtggcctttgattagccgttaacagaaatttcttttttttcttttctttttttttttttaaagagacagggtctcgctctgttgcgcaggctagagtgcagtggtgtgatcatggctcattgtaccctcaaactcctgggctcaagcgatcttcctgcctcagcctcccgagtagctgggaccacaggtgtgcaccaccatacctgcctaatattttaatttttttgtagggatggaggtctcgttatgttgcccaggctggtctcaaactcctggcatctcggcctcccaaagtgctgcaattacaggcatgagccaccgcatccagccctcagaagtttcttttgcattgaacttgccaagaaaagacccatttatatgatcagccccttgtaaagcgcgtgccctgtcttcagggtagctgaggggctagcttgttttactgtcccctccaaagtttccctgccatggttctaccatagaagaaatcttctcctttatcttccttagttgtggtcagctttcaggcttgccacacttcctcctgggtgagtaaagaggcacatttgggtgccctgggttgggcacagtagatttgaggtaagggagccagagtgctcatttctgcagcagggctctcatcctgcattttagggaagtgtctctggccccctgcaatgcgggatgtttttcttcttttttcctcttgctttatgttagcttgaaccagtccctggtgttttgcttcaggattcttttcttcctccctagggagtaattgcttagaaaatgccctcctgtcaaaaacacaaagtcttcaatgtcataaattggtagtggaaactcctccgtcatctggcttaatatttgaactgttgctaatggctaagagattgcagcatgaaggtgggtccctttggaagcctgttgggtcaactggggtgttggctgtctcctttggtcagtgtgtgtacagtcatttggggaccagcccattcatcgcaggcacttcaatcttttaatgctctcactctttgaagaattataggagccatatgctgcttcccaggtaaccgagacttgctaaaaatagagcttaaatggccccactgttctggcattggaaatcgttgctttttatttttaggccagcttgtgtgatccgtagctactttcaagcttgggcaataagaatcactgagcaagacctttgtcagttgaacactgttaaggtttgaacctccactcccagctagttggaaggagaatccaaatctattgaaatagggagtgctgaccttcacatggctcccctcctccacctccaccctctattaagcaggattctgtttcactgtgggtttagggtacttaccacaagaaaaatacgttgcaaagaatgaattctggctgtgagtttatggcaccagccaaacaaccagaagaacagactggcataaaacagctttgaggccattaaagaacaccaccaaggccgagacccatgcactgtgggttttgggtggtctgaaatggaaattgtcatcaccatacttaggtgcagattaatgcattaaatgataaataagaataggcctaacttccattgctcatttcataagtaatagtctcattttactatccccattcttgcccaccttcagttacagaaataactctgagtgggtttgctttttaaagatctgtgtcaagcagatatctcacaaaaatggcacaggcaaagtgttctatttagaagttgccctgtgacacaaaaccacagtgtgttttcagtccttgggcactggtttctttggacataagtgctaggggcatggtgccggccttccgggggaagtgacttgaaagtgctgtgggctccgcatagagagttttacttcattaacagtcgcttatccgtcaggtccaaaagacgcagcggtggtactggtaaccaggtatattcgtttcctattgttgccctaacaaattaccataaaatgagtggcttaaaacaacacagattttactgtcttacagttctgtggtcagaagtttgatgtgggtctcactgggctaaaatcaaagtgctgactgggctgcattcctttttggaaactctaaggaaaatcccgttcccttccatttcccatcttctagaggcagcccgtattccttggctcatgaccccttcctccatcttcaaagccaccaacagtgacccaggtccttttcaggttgtgtcacttgatcttctctcctgtgcccccgctctctttttaagaacccttgtgggtacattgggtccacctggataatccaggcgactcttccttttgtaaggccagctgatgagcaaccttaattccatctgcaactttcattcccttttgcttgggattgggatgtggaaatctttgcagggggtgggggggtgttgttctgccaatccacaccagggactttgttttcctaaatctccatgtcgggtagggccaaaggggcaatcattttggtggcagcctacgtggaagatggcttctatatttgcagagtttcaggaagttgagagggtttctcttagaccactagactgtgaagtttgtcagataccttgtttctctgtagggtggtcctggagttttgatgatcccagctgagactcttaccaggggctgctagagcctggggatggatggctgtgaaggggagcagggagttaggatgactggtagcagctgggctggccagcgagcgaggaatgaggaagcagggggatgaggacaggaaatgatagacgagtctgccccttgggagagagaaaatagaagatggggttgattacatctggccccaaagaaaataaaagcatgggcttttttgtttgtaggctttgtgattgattctactgttgagtcaacttagacgctgggctaaacaaatttatttgcttactttttggacatccagtgcactcttgccactaaaagcctcaggggttcattgtggccacttggtgtcccgagggaggttggggggtgttgggtgtcactgtccaaacaactctctctggagagagcagcagcccagctggggaccccgtcccaggagggctctgctctggagaatgtaaaccggtctggtacaggctcacagagccttaaatgtgttctcaagaattctaacaaataatctgttgtgaacttaaactggtttggactttgaagaactgacaagttcttttgagaaatagtacgtgggagctttgtgcatcctttcccacggtcccatgactgggaggtatgttacagtgaaagcaagtctcagacacgttttggccactcattcagacacttgttagtaagcaggcatgaagagagccctgctttagctgggcgtggtggcacatacctatagtccctgttacttgggaggctgaggtggaaggattacttgagctcaggagttcaaggctgtagtgagctatgatcctgtcactgtactccagcctgggcaacagagcaagaccctgtctctttaaaaaaaaaagagagcacactgcagtctgttttgtaagctcagcaaagcttgagccctctggccgggccccttttgggaaagagacattcaaggcagatgccactgtattccagtgccgggattcagctaacccccagggaggggacagggtcctcctttagtggttgacaatggcccctgacagtcctgggcctcttctctgaagggggcagactgctgttatttctagattcttttgtgcggttcttctgaggatggagatggtggcacaatattttcacccaattcctagagcagagggccactgcttgttttcatcatgctaattaaccaactctggtgcaaatggactctgattagtctttcaaatgctgatccaccatccctggagtgcttgtttttcatttggatacttcaattgtgagctgacctcttttaggataaggatcaaagccaagtaatacagagctatatgaggagacttcaacaagttcatggaaaatgggtattatgaaaaaactattcatggatttaaatttttttttttttgcaccaaaataaactcacactaacttggctgtaacatgtctgaatagtatctagtttgaggcactaagaaagataagacaccagtttggaaagagcccctatcagagcaacatgaattctgctaaaattgaagcaagaacaaacaccaaacttatagtgaagcttgagtggaagaatggtgaaataactgatgctttacacaaaatttatggggacaatattccaaagaaattagcagtttacaaatagatagctcattttaagaaaggacaaaacaatgttgaagataaggtctgcagcggcagactatccatatcaattttcgaggaaaaaatttatcttgtttatgccctaatagaagaggactgacaattaacaacagaaacaatagccaacaccacagacatctcaattggttcagctcacacaattctgactgaaaaattaaaaccgagcaaattcaatgggtggcaaaaccattgctcccagatcaggtgcaaacaagagcggagcttccagtggaaattctaaacaggtgagatcaagatcatgaagaatttattggaagaactgtaacaggagatgaaacacggctttcccagtgccatcctgaagacaaagcacaatcagagcagtggctaccaagaggcggaagtggtccagtcaaagcaaaagcggtcaagagcaaaggtcagggcaacagtttttggggatgctccaggcatgttgcttgttgacttcttggagggccaaagaacaataaaatctgtttattatgacagtgttttgagaaagtcagagcatgagcagaagaacatccaggaacagttcaccagagagttcttcaccatgacaatgctcctgctcattctcattcctcgtatcaaacaagggcaatcttgtgagaattttgaggggaaatcattaggcatccacttcacagtctgtatttggctctgactccttttttgtcctaatctttaaaaaaaatctgtaaagatcacctattttccttcagttaataatgtgaaaaagactgcattgacatggttaaattcccaagaccctcagttctttagggatgaactaagtggctggtgtcatcacttgcaaaagtgccttaaccttgatggagattatgttgagaaataaaatttataattttatcttttaattctattttccatgaactttttgaagtcctcatatagtacactgtttcttttttagtgtggattgctattttttttattatttatttttatttattttttatttatttttttgagacagagtcttgctctgtcgcccaggctggagtgcagtggcgggatctcggctcactgcaagttctgcctcctgggttcatgccattcttctgcctcagcctcccgagtagctgggactacaggtgcctgccaccacgcctggctaattttttgtattttttagtagagacggggtttcaccgtgttaaccaggatggtctcgatctcctgacctcgtgatctacccgccttggcctctcaaagtgctgggattacaggcgtgagccaccgcgcctggcctgctgtttttatttttaactttttattttgaacaaactttagacttatggaaaagatgcaaaaatggtatagtttccatatatccctttcccagcgtcccataatgttaacatattatataatcatagtactattattagaatcaggaaatcaacattgctatcatactatatatctaaatgctatatgctaaatactatactatgctatactatatctaatactgtactatagatcttgcttaatttcatcagggtttccactaaggtcctttttttgtggttgttctaggttcctcttcagaatccgtgttgcatttagttatttctcctagtctcctgcagtctgtaacagttccccagtctttcttgattttcatgaccttgatgcttttgaagagttattttgttgagtatccctcaaattggattggactggggttatgccttttaaaaatcatggtaaaatatacataacataaaatgtacgattttaaccgttttaagtgtacaattcagtggcatcacgtacattctcaaggttgtgtaaccattatctgtttccagaactttttcatcatcttaaacagaaactctgtacccatgaagcagttacttttcattccccctccccccagtccctggtaatcacacttgtactttctgtctctatgattttgctgttatgggtacctcatataagtagaattatacaatatttatccttttgtgtctggcttctttgacttagcttttgaggctcatccatgttgtagcatgtatcagtacttctttttttttttttttttttttttagaggtgggatctcactgtgttgcctaggctggagtgcagtcactgttcacaggtgggatcatagtgcattacagtcttgaactcctgggctcaagtgatcctcctgccccagcttcccgagttgccggggctacaggtgtgtgccactgtgcctggcctgttcctttttaaggctgggaataatattccatagtatggatagagtacattttgtttagccattcatctcttggacacttgggttgtttctaccttttggctagtgtcatttatgctgccatgaaaatggatgtatgaatacttggttcacattttaaaaggaacttggagaaactggagaagagacagtttggagcaggcagaaaaaggcactattttgtgtttcccatccctgactgaggctttcacagaagcaagggagattgagatgcagtggggcagggagatggcaagtggactcagagacaggtgccagatggttgagaggccaggaggggacagggagcccaacctattatacttgtccaaaggtgctgccactaggggaatgcccagaaggtgcaaacaagcccactggacagggtcaaaggcctaggaaccagtaggagaatgggttaagaccacgatttgctgcagaaagcacagtttgctccacaccacccagagccaggcaggatggtataggcatgggttgggttgaaaattaagtccacttaatatttcttcttgatgtttttcaaatttgggggactatcttccagtaagaaatatatcttaccttgcagccttgtaaacacacctgtctttagttatgattgaaatagtaatttcaggctgggcatggtggctcatgcctgtagtcccagaactttgggaggctgaggcgggtggatcacctgaggtcaggagttcaagaccagtctggccaacatggtgaaaccccgttgctacaaaaatacaaaaattagctgggcatgatggcaggtgcctgtaatcccagctactcaggaggctgaggcaggagaatagcttgaacccaggaggcagaggttgcagtgagccgagattgcaccattgtactccagcctgggcaacagagcaagactctgtctcaaaaaaaaaaaaaatagtaatttcacaacaaacatttgatgtgctctcatattttctatgcagttctgtttcattaaaaaatgcttcttgtgacctgggttcctgggttgccttcatcttgaaaacactgtactacacaaagcctcatatgcgaagttctttctgccagttacttttctttctctatcaagtttttgtccctttccagttggaaaatgtaaaccatgtaattgatcacgtttctctttttgttttggctatgaggcaacacaaaccttggcttgaccaagcgataggtttctatatggcggtcatatactgtacatactgatgccttaacttttcctagctcttgaccttctagctatatttttcctgattctaattggtcatatatttttgttttgttgaattcttgggagctgccacaaatctatatggagtgtgatgatggaatatataacaaatcatggagaacttttgatcttgactgagataaattgttgagtaaagtctgcatctttagagattttgtttttgagacagggctttgctgtgttgcccaggccggagtatagtggcatgatcatggctcactgcagcctcgaactcctgggttcaagccatcctcctgcctcagcctttggagtagttgggactacaggtgtgtaccaccacacctagccaattaaaaacagtttttctttttgtagagatgggatctcactatgttggccaggctggtcttgaactcctgacctcaagtgatcctcctgccttgtcctcccaaagtgctggtattacaggtgtaagccactgcacctggtgagattttattttttttgtgaagcacggtctgggcgatatgattttcttttagctttatgattctccggtttacttttctggcttttgtttcagattacctagaaagcaacctcttcctttttaatttaattttatttattttatttttattttattttttaagatggagtcttgctctgtcaactatcctggagtgtagcggcacaatcttggctcactgcaacctctgcctcctgggttcaagtgattctcctgtctcagtttcctgagtagctgggattacaggcgtgcaccaccacacccagctaatttttgtgtttttagtagagacagggtttcgccatgttggccaggctggtctcgaactcctgacctcaagtgatccacccgcctcggcctcctgaaatggtaggattacaggtgtgagccactgtgcccagcccctttcctttttaaaaaaaggaatttatcatagtggcaaaggtagaattcaaggaagtttggaattagtgtggagggaaggtgtcatttcatctttaattaaggccgtttttacttgtactcacattgcatagaattctgtttacgcaggtgtttttgtttgtttgtttgtttttttaacagaatcttgctctgtcgtccaggctggaatgcagtgacacaatctcagttcactgcaacctccgcctcccaggttcaagcgattctcctgcttcagcctcccgagtatctgggattataggcgcatgccaccatacctggctaatttgtgtatttttaaagagatggggtttcaccatcttggccacgctggtctcaaactcctgacctcaagcgatccacccatcttggcctcccaaagtgctgagattacaggtgtgagccactgggcccagccacaggaatgtctcttaatcaagctccttgcttctattcccctgcctcatctcaagttcccattcccctacttgatttaccatgtttgctgtctaactagtgtgttcctgccacctgcagcctctgcccatgagtccttctgccgcaggtgtcatcagagaacacatatttatagttatacttcctctctgctcccaaacctccagttactccccagacttgcggataatgcagtcttttgagcttgtatcaaggacagagcccatcttgccaattgattagagcaccccagctttcaccctgccctccccgcctccagtccttaggttggaaagctctgagagaggatgaaatggacagaccatctgatgcatatggacctcttgagagatgatttagaccagggaggatgagtttggagttgaatccatttttaagtgaactctccactaagcaaaaaaaaaaaaaaaaaaaaaaaaaaaaaaaaaaagactagtattagctctaggggaaaagaaactagtgataggaaagaaacataatcttagtgtaccatgtggctaggcttttagtaatgtttgtgtagtcataaggatgtaaatacttgtgttagttttgtagggctgccagaacaaagtaccatggattgggcaccttcaacaacagaaatgtgttgtctcacggtccgggaggctggaagtctgtgatcaaggtgttggtggggttggttccttttgagggccatgaggttcctttcgaaggctgtagttgcctctggggaggggaagttggggagaatgaagaatgctttttttccataagagacctttacagctatttgaaactttaactgagtgtgagggtgacttgggtgacctgggtcagcatagcctgtgccgcctgcaccgagctgctcttgccttcattcgaggtgagaaaaggaagtggggatgttatcggccttaaaggtcgctactgacaagaagtgaagtcttgggctttctgaggcccgtttatcatttcattctaaaataacccaatagttactttttagctccttatatgagatctactttaagatactccaaagcagggctttttgggggagggtagtgtagtttattgcatttttgtaattcttcagaagatatctactttcttctctctgttgcagttattgatttagaagcaagctaggagcatatgacagaaactgtcagtaacccactctgaagttaattttgttttggttacaggtaatagtttcatgtctacttctgtggggaacagcagtgatagatttcctctcctttttttttttaaaagctttccttttacctgtgcaaacctctcagtctccccatgctcccatgatgcgatgggggagacactgaacacccaaatgggcatttctatctgcagaaaccctaagttccttctactggtgttaaatagcttgtggaatgtgttagtctgttaagtagccagtggaatgaatgtattaggtcatctgtggaaacaattagaagaaaaaaatctggcaaaggagcagaccaggaaagtttaaaaaaaaaatcctttctggcacgcagttcaattagattagtatgagttgttagaaattaatgtttgcggtgtcagtgagcacacttaaacgacaaaaaagaaactcagttgcagtatgtggcacatcattaaacatatactcagatgtttatttaaaaagtatagatctgtatttcttgtatgtgtagcactgagccaggtagaggctatgtgtagcactgagccaggtagaggctatgtgtagcactgagccaggtagaggctaagagtaaatgaaaatatataatacctggtcctttctcttaaggagcttaaatctgtttggaggtagcaagacatagaatgtaaaagataatgaaagggttaaaataacagtctgagacagggatcagcaaactatagcctacagctaaaatctggccttctgattatttttgtaaataaagctttatggaacacagcctcactcatttatgtttgttgtctgtggctgctttagtgctgtaaaggcagatttgaggtgttagagtggaacattggtcccaccaaagctgaaatacttactatctgactctttaagaaaaagcttaccggcggggcatggtagcttatgcctgtaatcccagcactttgggaggctgaggtgggtggatcacctgaggtcaggagttcgagaccagcctggccaacatggtgaaaccccctctctactaaaaatacaaaaagttagctgggcatggtggtgcgcacctgtaatcccagctactcaggaggccgaggcagaagaatcgctaattgcttgaacccaggaggcagaggttgcagtgagccgacatcgcaccactgcactccagcctgggtgacagagtgacatttcatctgaaaaaaagaaaaagaaaaagcttaccaactccttgtctgggataataattcaaaagatgttacaaagcagtgtatgaggagtaaaagtgatttagtgaacgctatagttagtaagtctgagaatgatggaatgacaggtggcttgaaaaagggttttgaaggtgacctcagaccaagagattggagggcactttgtgatgtaaagagttgggaaggagatttcatggatgggagcatccatggggctcttgggggaagatcgtgtggggagatggggaccaggactatccagctggacttagagccaggtataaatgcaggtgacgttgttaatgtcaaacctgtaccatattgaagcggcctttgagttccaggatcaagactgggaacttcctcaaacccataatatctttcaaaggcaacactcatttacacaatcaatattcattccagacctattatgtggttgactccaaggggatgttaacatacatgtaggcacatcgctctcgtagactggtgagtccagcttgtttgactcagtgctagttctaggtatgtttaaagaaatagctgccggctgggcgtggtggctcacaccagtaatcccagcactttgggaggtgaggcgggcagattgctggaggtcaggagtttgagactagattggccaacatggtgaaactccgtctctactaaaaatactaaaaattaaccgggcgtgatggcacatgcctgtagtcccagctactcaggaggctgaggcaggagaattgcttgaacccaggaggcagaggttgcagtgagccgagatcataccactgcactccagcctgggcaatagagcaagactccatctcaaaaaaagaaagaaagaaaaattgtcatttagaagagaggtttaacctcaagaccctccaaaggctgctaataccaggagacttgtatggacaggtagtctcccattctgtgaggacagtgttctagagagagtctttgagaagggacttctggctgttgtttttttttttagatggagtttcgttctctcttgcccaggctggagtgcagtggtgcgatcttggctcactgcaacgtctgcctcccggattcaagcgattcttctgcctcagcctcccaagtagctgggactacaggcgcccaccaccacgcccggctaattttgtatttttagtaaagatgggatttcactatgttggccaggctggtctcgaactcctgacctcaggtgagctgcccgccttggcctcccaaagtgctgggattacaggcgtgagccactgcatctgggcgagaagggacttctgaaaaggaatgttgtgtaggtgagagatgtgccagggggaagggaggaggagaacccccacccatccttagacactgtattgtccttccttccttttagggcttctgtgctgtctaccattttttttctgggtctgcaaagctccctgcacatatcctcgcagggtgtgcttccaccctttaggtacccagccctatgcagttggtgagacatcataatgtttccacatgccaccatctcccctactccctgaccaccccctccaagcctgtatcctgctgtcttggcatctgttaggcactgagcttccccactttccctagatcagtcctgccacaggccactgagctcacctcaaaatcctttctctcctacctggacacagccctggggcacctgggccctgcttgtctctggccctgcagtggtcctcattgtcacccattaatgcttccatttacttctctctcactcttttttcttttgtaaattaaaacacacacacacacgtgcacacgcacatacacacacatacacagagacagagataaaagaaaattctgtagtgcattttgcagtgagtttattccagactttctctcctcaagctcctcaaattctcttctcacctgaccctaaccaagagatgaccttgattcctgtttaagagaaggcgtcaactcgcttgtgtactctcatcttcatggctttatatcactgttgtaatgttgatccacttttatccaatgccagagaaagatacccttccttcttttttttattgttctctgacttctctccgatcatgcattcctgactcatctgcctgttgtccagcatggtgaccctgtccccgcagaccgtcagtaagtacttactggatcaaagagccattctgtctgagaaaatgtcagctaagaatgtagaagggcagcaggcctaatttggcctggtttcatatttgaacctactgcctatattcatgtgtgcaattgggtatgttcgtggatttttttttttttttttttttctgtgcagctacagtatctggaacatatgtctcagaaaatctttattgattgaaaaaaatatgagcaggaacaggggcaagaagacggactttgagtccagactggctggcggctggaatattatctgatctctctgggagttggattctttcctaaaccaggaacaataataggcaccttgtagagcgtattccagttcctgttgctgtgtgacaaattactccaaaatttagcaccttcaaaaagccattttatgcttaccagttttgtgggtcaagcatttgtacagggcgtggtagggagggcttgtttcagctctacagtgtctggggcctcggctggaaaggcctgaggtttggagtggacatgacagctgggggctggaacgatctgaaggctgggtccctcacatgttgggccaggctgggatgactcagtaactaggcatgccagctggtgtgtctcagtgcaaattggcttccttacagcatggctgtcttggggtattccagcaagtgagttggaaactgcataatatggcctagaagtcacacagcatcactttcctccactctgttggtcaaagtggtcaccagcctgcccaggttccaaagcccggggaggaagattagatttctcctgttgacagctggatcacattctagaagagctcaagggacaggagatgttgctgtagccatcttggaaaacacaattggccacagagtgatcgttacagttaaatgatacagtgaggaggataaaggcacctgacacaagattttaagagtatattttctgccgggcatggtggctcatgcctgtaatcccagctactcagggcgtcgaggcaggaggatcagtagaggccaggagctctagatcagcctgggcaacatagtgagaccccttctctacaaaaaataaaataattatctgggcatggtggcaggtgccagtagtcccagctactcaggaggctgaggtgggaggatctcttgaggccaggaggttgaggctgtagtgagccatgatcgtgccactgcactccatcctcggtgacagagtgagaccctgtctcaaaagagtatattttcatttggtaaacatttatgaagttcctactatatatcaggccggtcctgggtctacagaggcaaacaaagcagacatgctgtctgtcctcctgtagctttcagtctagtggcggacacaggcagtaatcacatgtaattagatctggaaattcctcctccttttctggacaggggctggtgaaacatctggattcgtgtgttgcattttaagtgtttttcttttttttccccagtgaatgatgaggaaggggatctgcccattgttaatgtggaacctcttgctgctgtttgttttgttttgatacttctacagatctggaggctcatagcactgaaaggtgccttgtcaggcttgaggtctgcaagcaccccctgacccttttgttcagcttcagacttatgtttctctttctgcaaaagggatttaggagagtagtaggggtacatagagtcacctgggagatcatcttcagcctagacatgacccaccctgccccccgccccattctgatgggaaccagggtgtggaggagacaggcatgagaaagtttcacaggggattctaacatctctgggtgaggaacccagtgtgagatgggccagcgcttcccaaaccatcccatgcatgtgagtgtcctggggatcttatgatgcagcctcagattcagtaggtctcggggaggctgggggatgcctctgagtagtgagggtatgtggagtaccaggcgggtacagatagagatgcctgtggaagtttgctgcaccctgacgaaagggccagttctcagagagttagggtgctgagggctagccaggtgagctaccagatttctgtcatgtttcagcacgcaattcttacagataattactctgctaaaaaccataatcacaatatcacttttacacctaaacaacgcaaacaacagccttccttatgtaaaacacatctcaagaaactcaaattcagaatgttggcagaggtggccttgtccacactcatagatctggtgtagaacacacttttgattgtgctacttactcatttttaagtagcttatatgtattttttaagtagcttatatatcccagcactttgggaggtcgaggcgggcagatcacttgagttcaggagttcgggaccagcctggccaacatggtaaaaccccgtctctactaaaaatacaaaaattagccaggcatggtggcgcgtgcctgtaatcctagctatgcagtaggctgagacatgagaatcacttgaacccaggggcagaggttgcagtgagctgagatcgcacctctgcactccagcctgggagacagagcaagactctgtctctaaaagaaaaaaaaattatagatgcccagtaccctttataacaaattcaaatattgaaacatacatatgtatacaatacacacatttaatattttgttgcctttaaaacccccatcttcctttccaggtgcattgctatgcccagcatggtcagctgaatcatttgtgaaatagtgattacaccagctagagttacgccagcataaagatttgcatgttttcagttcagtgtaggacattattcttctacttgcacatgtagagcattttaacaatccggaagtgtttcagcatatattttgtaaagataaggactcttttcaaaaccataatcacaatcatttttacacatacagcaactaacagtgtttccttatcatcagacatttaagttcaaatatccaatttttacatgtagtttaaatattttaaaaggtgtttgtttgaatcacgatttggaaggtctgtactttctaactggttggttgtctctgagtctgtttttttttttttttttttcactctgctacccaggctggagtgcagtggcagtctcagctcactgcaactgctgcaacttccactttctgggttcaagtgactctcctgcctcagccgcctaagtagctgggattacaggcacgtgccaccacgcctagctaatttttgtattttttgcggagacggggttttaccatgttggccaggctggtcttgaactcctgacctcaagtgatccgtccacctcagcctcccgaagtgctgggattacaggtgtgagctaccgcacctggcctctgagtctgttgtaatctaggttctgccatctctttttccttgcttttgttgttgttgaagaaactaagtcatttgcctacagtcctacagcctggattttgcagattgcctccttagagtgccatttaacatattttcggacgttctgtatcccctgtaaactggtggtaaatccagaggcttgatctgattcaggttccgtttgttggcaagaatattttgccagcggtgacacacacttccatcatgaggctccagatgcctggttgtctctctttttgtaatgtccacagctggccaggcacggtggctcatgcctgtaatcccaccagtttgggacactgatgccagaggatcatttgagcccaagagttcgagaccagcctgagcaacatagtgagactctcatctctgaacaaaaactttaaaaaataagccatgaaatttaaaagaaattaaaaaaaaaagctggatacagtggctcgcacctgtaatcccatctatttgagaggatgaggcaggaggatcatttgagcccaggagttccaggctctagtgagccatgacaatggcactgcactccagcccaggtgacagagtgagaccctgtctcaatcaatcaatcaatcaatcaatatccacagctgctagtgaccattgctcaggttcttgattgcattagaggttgcaaaacgttgattgtccaattctctcattccttcttcattttattagccagaatattcctatacagagaaatttctcatcaaccatttggttatcttgaattcatataggaaaggcaggacaaatgtttgattctttttttaaatttaccagtttcaaaacaatgagttggctccctagcatcttccaaaggtggccaatgatgttttaaaagtatcactgtgaaagatatatcacataacatatgagacatcaaattaatttgatgtctttcaatccagttattgttactaatgcagttattatttcagtgcactttcaatgctgtttcaaggcagttattgttaatcatgctcatgttgccccatttgtggccagtgggagcctcttcaggttcacttctgagttgttttgacatgaccctagtagtgtttgctggcctccttgctttcttggtgtgacaagatggcccaggcttatcacctttcctgccccagaaatgaaatcagccatttatctaagggtagctggctttctttttgtgaaaaacggtatttggagactgaatgtgattatttcagaaaaaaatgtatacattgctcttcatagatcattattcttaggagtcttttggtgtgaggctgttgatctttttaattttatttacttattttcactaactcatatttcaattttgggaaaggtttcaaaaattttaaacccaatccagtttatttaggttttattctctttttcgaactttaagctataaccttcaaaggaaagcaaatgttgggttttaacttcacttcttttttgtgttactctatatagacacatacttactcagtggcttcctgatgctgcaataaagtatttacaatgtagttgattaagaaaacatttgtgaagtagatacttgactagcaactttttagttcaaattattgttcaatattaaaaagtaccaactcaaatgacttacaaacgttggtagttactgtcttgatagactcccaattactatgtgacatcattggtgaaacttaggatgaaaccgtgaaatgcaccctccctaataacctgcacattatggtgttgcagatatgctagatggtatctccagattagatgtctgggagcctaaagtagttatacttatgacagtttgaaattctagactgctttgaagagctgttattttgctgttatcttctgcttttatccctgtacatttgtctcagatctcatctcagattctcagcttcttgtcaaaatcatccttgcaagtttcttgcccctcgacaacaagcatttcttgagtgcctgacggggccaagcactcagccaagcacttgagggaggaagatgcattgggcaatatgacttttctttcaggaggcccatcagcttctgttttacatgtcccttttgccttctaggggctcgcggtagcaggattactacacctgggagtataaatgaagcctgagatgggacattaaatctgccggggagaaagcagtgaggattcactgtggtttcctctcacgttacctcactgtctgctatctctcttatgagaaagtatgtttcttaacagaaggccatgcagtgagtgactcagcccttgcccacccccaaccatgctgaccaaccacatttttctgtggaatcgttcttccctccttttgacttggtccctgcctcttacagctgattcagcttagccacactgaaatcaacaggaaggcttttgcttttcttctttcatacaacatgtccaaatataaagccaacctgcccccttactatcctatcctcaagacaagcaagagttgctttccatgatagtccttacaaagtatcctgtaccataaaggctctatgaatttattttgaataaaatagttggagcaaatccttcagataccttatccataataaaattgtttcatgaaatgagagggtgttggggggtggggagcgatgttttctaattattttatttcacataatctgtaattacattaatacatagtataagcagacacttgactgtttcttcttctgttttgaggtttacatattcaggttagcccacaaccttttggatcttctcactgagaaaaacaggggatctctttctaatcaggcacttgtctttgggtcttttttgaatctgagaactaggctatcattataaagtcaggaaaatctctactcatcctcaagccattttattatgtaacactgtcaaatatttatataaagcagcatactttcttctccatgcacaaaaaaaggttatgtctttaagtggctaaacttttttgactaaacagactttttattaaattggttttctggccagatgtggtggctcatgcccgtaatcccagcactttgggaagctgaggctggccaatcacttgaggttaggagtttgagaccagcctggccaacatgatgaaaccccatctctacttaaaaaaaaatttagctgggtgtggtggtgcatgcctgtactctggaggccaaggcaggagaattgtttgaacccaggaggtggaggttgcagggagcctagatcgtgccactgcactccagcctgggcgacagagcaagacactgactcaaaacaagaaaagaatattgcttcataaacagttgtgcctagtagctcaggagactacaattaagtccatttaaaaaatgtgtttttctgagattccatgtaacactacctgaaaaaaagtagaatgatgggaattaattggaggctctaaaaactaaataagaatatcgggccaggcatggtgactcacccctgtaattccagcactttaggaggctgaagtgggtggattacttgatgccaggagttctagaccagcctggccaacatggcgaaaccccgttctactaaaaatacaaaaattagctgggcatggtggcacatgcctgtaatcccagctactcaggaggccaaggtaggagaatcacttgaacttgggaggcggaggttgcagtgagctgagatggcaccgctgcactccagcctgggcaacagagcaagactccatctcaagaaaaaaaaaatggttttctaagattccactgatttttcccctccgtgattgttgtatagaaccattctctacacaggcttatccagctttaacctgttgtctttattttttactaggttttgttgttgttgtctgcctgtttgtttttgagatggagtcttgctgtgtcgcccaggctggagtgcagtggcatgatctcggctcactgcaagctctgcctcctgggttcacgccattctcctgcctcagcctcccgagtagcggggactacaggtgcccaccaccacgcccggctatttttttgtatttttagtagagacagggattcaccgtgttagccaggatggtctcaatctcctgacctcgtgatctgcccacctcggcctcccaaggtgctgggattacaggcttgagccaccgtgcccggcctgttttttaacctgcaaagtcacctgcccactttctccattctttctttttcacttaaaaagccttcttctggtcaagttatttttatccagtctatctaatggatattctattttttgagacggagtctcactctgttgcccaggctggagtgcagtggtgccgtcttggctcactgcaacctctgcctcccgggttgaagcaattctctgccttagcctcccgagtagctgggattacaggctcccgccaccacgcccggctaatttttttgtatttttagtagagacggcgtttcaccatcttggccaggctggtcttgaactgctgaccttgtgatctgcccatcttggcctcccaaagtgctgggattacaggcatgagccactgcgcccggcctctaatgcatattcttaaaagagctgtgtgttaggtttgcaggggttaatttcaggaagcgtttgataaccctttgtttttgctccttgaggttttgttccagggacagcccctggtgaggcagaggcttcagaaggcaagtggtaggggactcaaggcccacaggtcttgtgaatgctttcccatccaggccctgcatttcattctgatctttgattgaatgcccctctgctatataggcattggttgtggtgaaggtaagagtgaaatcaagactgatcacagtaacttgagaggcctggactagtggcgtatacttgttttgtggccaactggtcatgttgatcatcagctttctctagccttcaagttaaataacaaggctcacatttgtaactgcatttctttgagttgaatggtaaggtatagttcgaggtcagtactttgtaaggacactcctggtgtcgtatggtgcactcagtcaccaacatttattgagcacctactttgtgccagacaccagacgaggaggagagggtgctcagatctgccctttaagagctcccattccagggtgtgtgtagggagggcatgtcggggaagccctcacagcatagcatgataatgacctgcaagactagcatctggcattaatggagcagcttctgtatacagtttacagatatcacgtctcacccttgccacagatcaccttctgattttaaacacaaagaaagtgggctcgagctaggaatctcaccccatgtcacacagccagtgaatgtctaagctggaatttgctcccaggcctgctgggctttctcctacacctcatgcttagaggtgacaagagaggagagatgggctgggaggctcaggttccttgggccttcgtggaaagcagcaagtgacaagagtatccttaatggtgtctgaggcaggcaatggtgggcctttctttcctctcacacagccgggtttgttttttctcttctttcttgattcatctcttttctgctttccctgctgctccccaattctttgagctgctactgggcctgctacagacattgttgaatcctgccagaggccatccagccacaggtgtgctgcctcctgcccagggagagagttcaggcccagggactgtctgtcactggggtccgtgttctgagcctgtctttgttggggaagctgatgttcagtttttaagatgcaggtcttgggaattacctgcttgttgggttgatgtcccttagtggtgtgtttgtgaagacaccaaaaggaaaacgtggctggtatgtaggtcagctttattgtacgcggagatccccacagtatctgtggccttgacctgggaaattcagacccccaaacccttcagccctgacactaatgggagggcactggatggtaagaacttggccttgtgcagacttgcatagagaagagtctgtgtgtatgtaaagttgatgtatggccaggcatggtggctcacgcttgcaatcccagcactttgggaggccgaggtgggtagatcacctgaggtcaggagttcgagaccagcctgaccaacatggtgaaaccccttctctactaaaaaatacaaaaattagctgggcgttgtggcaggtgcctgtaatcccagctactcgggaggctgaggcaagagaattgcttgaacctgggaggtggaggttgcagtgagccgagatcacgccattgcactccagcccaggggacaagagcaagactccgtctcaaaaaaaaaaaaaaaaaaaaaaaaaaagttgatgcacgagtatctgttacggttctctggttttaagtaaaagaaaccaactcttccttaactaaggtagcaaaaaggatttatcagaaggcattggggtagtttatagggtggaaggagaagctagaggatcaggtctgagaaagatggcaactgggcagcttcagggatctcacttctgagagccctggtgggggaatctgctccagccgtctccagtgtttgtcacattgctttgatcacagttgggtcctatgtcatacattggctggcagagggcagggcatgttgatggacagtcccatcaaactatctcatggtggaggggaagttcccccaaacagttcccctccctgcatggggagtgttctcctgctagggcacaaacacagtctaccacctcaatgaccgacaatctacaataataaattcttaaatatatattgtttagacttttaattttaatattattatttttttgagatggattcttgctctgtcacccaggctggagtgcagtggcatgatctcagctcactgcaacctctgcctctggggttcaagctattctcctgcctcagcctcctgagtagctgggattacaggcacgtgccaccacacccagctaatttttgtatttttagtagagacagggtttcaccatgttggtcagactggtcttgaactcctgaccttgtgatctgcccgcctcggcctcccaaagtgttgggattacaggcgtgagccactgcgcccggccaatttttatttgtaaaagctgtactgaggtataaaatttcacccattttaagtgtacagtttaatacttttcaagtaaatttacagcatcctgtaactctcaccacaatttaatttgagaatatttccgtcaccccaaaaagattcttcatacccatctgcagtccatccccattcccatccccggccctaggcagccactgattggttttctgtctttttagatttgaacatagtttttttttaaatatgttcctgactggtgtaactttttctgggtattctggaaactatgttatacatgaaagaaaaaaagagcccccccccacccccccgcccgcatcaatggtgtgaaagtctgtatctcgctggtctcaggtttctctgctttctcttttaaatccttccttctctccagtggaccataatttaggagaacgtagccctgggcttgatgctgccattatttacctctcaatgtctctaagcctaagtcatggaaccttctaggcctcagttcctcatttgtaaaattcaggaaaaaaaaatagactagatgatatctgatgttctttccatctctaatgatcagtactcatgatcttttttggtgaagtctgttttggcaaaaaattacttcttgattttctatgcccttcagaggactgaaacaaaacactaaaattaaaaatttattcttcagaattcacagaacacaataagtgcaaaagcagtaagtgtgtaacatttctacttctgaaatgattaaagcttactgcactgagacctctgtgacattgtgtatatgtgtatacagcggaggaaattaattggaaactttcattctccttcatgctttctggtttattcaaatatttattgaagcagacaggatgctaggtgaaggatttagaatcctggcaaagataagggcttttcccagatgaaggttgcagtctagttggggtaagtcagtgtgaaattatagtgaggtgaactggtcctaggagacaggaaggacagtgagcagagggaggtagggaaggactgggtcacagagcagggccacggatataccaccgccaccaccaccgccatagtgagaagctggccctgagaagctgctaggcagctggcttagccaacccacagttaaaaaccacccatttcgtctttgggggaggagacattccagcaagtttgaaggtagagataggggagggtgaagtgttttgcatttctaagcagatctcttatctcccctggctctatctttttgtaacatggggttaactgtagcattggtttttgcagtgactgtagatgtagcaaacttgtggaggctggccttttggcacagcacacagctggagggtggtatttttctgacagggagatgttcttaagttttgtaatttatggtgtctttaaatatgggattttgtttactgttatcctaattacacctctgatgtattttatttagcttaatgttttaattttctgctcatacccagaggtaatttctcaaagggtaccactttaaaaaaatcataggtaatgtttcatccttcctgcagttacctgcagcctctcgaaggcaaggaaatgggttttgggggcatagactttcttctgggctcttgtgatataattttggctgtgtttgtatcatccaagatcttcaccacctgtttgccaagtattatcctaaaccattctgttctatagagacgtgatacaagccacatgtcattttaaatgttctagtagtcacattaataaaattttaaaaaggtaaaattaatttgtataatatatttatttaacccaacagatctaaaacatcacttcaacatgcaattgatgtgaaaataatgagctatttcacattatttttttctaaacaagtctttggaacttgggatgtatcttatggcacacgtcagttcagactagccacattccaagtagtcattagccacatttgcagtgacactgtattggacatcaaagttctaaacctttcaaaggcttgcagagggcactggaaagagcccttagagtgggtaggagagacatatcctcatgatttatgagctcttaacaaagccacaggtttcctcttcttagagaaacctgatatgtaaaaaaaattcatcttgacaggaaaggtaaagcaggaagtaattattcatgttacaaaagaattaaccacaggatcttttaaatagcaagctcccttagtgcacggaagaatatgactcaatttgcaaaatgtgattgacacttgacattttagtagcacctttgttgggctgggaacggtctatcatcataaaatgcaagctgagtggtcagttgatcaagtctttattgagcacctactgcatgtcatggatgcttataggggccccagcagaactaagggtgatccatacccagaaggcattcaggggctcacagggaagacaagacacagcttgggattgcctcagtggcaggggccagagaggccttgggtctagaagagcttggaaggtgatgtggaggcagtcaggacctagctgtggccagaaggcaaggaggctgtgcatgattacttaagtttaaagaaagggcaatggccagggtggtcgctcacgcctgtaatcccagcactttgggaggccaaggcaggcagaacatttgaagtcagcctgaccaacacggtgaaatcctgtctctacaaacaatacaaaaattagctgggcatggtggtgtgcacctgtagtcccagctacttgggaggctgaggtgggaggaacacttgagcctgggagacagaggttgcagtgagctgagatggtgccactgcactccagcctgggcaacagagccagaccctgtctaaaaaaaaaaaaaaaattttgttttttttttttagtatcttcttaattatgtatagattgtgtacatatattcctgtactaattgaagatcaagaaaaccccagagaagctcctacgctgttattattaggcttaacaaacttttgaaacacataaaattgagtattgtatgactttagacattggtggaaaaatgaagacattttcttcatggttcaggtacatagttttaaaatatcttgctaatcctgatggttccacacttacaccaatgtcaggggtggaaagaaacccatattatgaatgatcttgataactgagtgtttgggggccatctccccgtaagatctgatgtgtcttccccatgtggtgggcaaagagctcccagcagaagctgaagtggcaactctatcattttctttctttctttttttccttttctttttttcttttttttttttttttttttgagacaaagtttcgctcttttccccaggctggagtacagcggcatgatcttggctcaccgcaacctccgccttccggtttcaagcgattctcctgcctcagcctccagagtagctgggattacaagcacccaccaccaagcccagctaatttttgtatttttagtagagacagggcttcatcatgttggctaggtaggtctcaaactcctgaccttgtgatccgccggccttggcctcccaaagtgctgggattacaggcatgagccaccgtgcccggccagctctcccattttcttggcacttggcctcgtgttgtctacagctcctactttctttacacagatcttttcaagcagctgacccactttgtgagggtgatttcagcaagaaggggtcatagccataaggaggctgtaccaggaggcaccagagaactgcagggcaccccatggtggggacacagtcaaaccatatcagatgggaattattagctttgacatacaactgagacctagagaagttagcatcacatggaatgctggtgcttgctctggtggtactccttgattccactgtccctctggctgcttcctgccccttaaaggatccctgactgtgtgtcctggagactgggtgaaggaacctgtgtcattctgtcaatggaacaatagagaagttgaattattacttttttaaagttaaaacaaaatgaatagacattgtaatttttttctcccatcatctcaatggatgcttaaaacctatctcagtgtattgaagttggtttgttgttgttgttgttgttgttgttgttgttgttgttgttttactcatttgtgctttttgtctcctatttaagaaatctttgccaaacctaaggtcattaagattttctcctatccattcttataaaaagttttacaattttagctcttacacttaggtctgtgaactattttgagttaattttagcatatgcatgctttacagagctcatttaacttttcctcttccattattttatcataatttctgaattgctaatttaccactggggatttatctaatttttgctatccttgtattcattcatttgccattcattcattcattcatacggatctgcaaataaaaaaggaaaaggtggctgggcacggtggctcatgcctgtaattccagcactttgggaagccgaggcgggcagatcatctgaggtcaggagttcaagaccagcctggccaacatggtgaaaccccgtctctactaaaaatacaaaaattagctgggtggggtggcatgcattcaaggagaatcgcttgaacgtgggaggtggaggttgcagtaagctgagattgcgccactgcagtccagcctgggtgacagagtgagactccatctcaaaaaaaaaaaaaaaaaaaaaaaagtgttatgaaattggttcatattgaggtggtcatgaggagaagtccagtctaaatgaattgcataagttaactaatttttggattggttaatgctgctaatttgcattggcactttgtcagtgagaagacccacctttcttacctgttgcctttgctcattaccaagtatgagagattttcatagatcaggaaaacaatgtaacatggaattgatgcgtaagagctcatctgttgagagggcagttgtggttctgatgtaggcggtctgagacattggcttggccagccaggccctctatgccacctgtctttacacgtgttgttgctgcaagatgggtgttacctctgtcggatggtgtattagtctgttcttgtgctgctaataaagacatacccaagattgggtaatttataaaggaaagaggtttaattgactcagttcagtatggctggggaggcctcaggaaacttaacaatcatgacagaagggaaagcaaacacatccttcttcacatggtggcaggaaggagaaatgccaaacaaaagggggaaaagtcccttataaaaccatcagatctcatgagaactcactcactatcacaagaaaagcatgagagtaactgccctcatagttcaattacctcccactgggtccctcctacaacacttggggattatgggaactacaattcaaggtgagatttgggtggggacacagccaaaccatatcagatggggattattagctttgacattttgtacaactgagacccagagaggttagcatcacatagtattggcgggggatgggagacccagaagtcaaaccgacatctgttgtctgtactctgagctcggggagacaatgctggacaccctctgggtggggcaaatgttgttatctggctgtcatcatgcagcttcccctctgaagcgcctgctggccccaagacctgtaggccaccctgcctgtgcctgaccacggaccagcactttgtggtttctgtgctataggcttcaggttaaccaaaattgggttactgtgtgtggccctgttattttgaatatttgtagaggggaagtccctttaatgttactttactggccttcaagggatactggacctcagccttctccaacatctgacctaaattactctgttttccctgttccttccagtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagtgagtacaaagcaaaacccttttcctgtctcctgtgtgggctctgctgaccaaagtctatgggggcgcttgaggatgaattgcatgaactctcttagggaatggcttgccctcctctgtgatatcaagagaagcatgtatagttttgcccttggtatctgggatacttgttttgaaattgcttttttgaggctcaggatgatctctttccactgtgtatcacttcttaggatatgctaaggctgggtgcagtggctcatgcctgtaaatcccagcattctgggagactgaggtgggcggatcacttgaggtcggaagtttgagaccagcctggccaatatggtgaaaccccatctctactaaaaaaaaaatacaaaaattagccaggtgtggtggcatgtgcctgtagtcccagctactcgggaggctgaggcaggagaatcgtttgaacttgggaggcagaggttgcagtgagctgagattgcgccactgcactccagcctgggcaagagagcgagactgtctcaaaaaaaaaaaaaaaatagtaaaggctgttaaattgttgtatgtacttgtttatttgctttggaagtttaaaagaattttatttttttctattccttgcaaaatggaggtaaaactcagttttgaccacttaaataacaattaaattaaatgtagaattcagccagacatggtggctcatgcctataatcccagcactttgggaggttgaggcaggagagtcacttgagcccaggagtttgagaccagcctgggcaatatagggagatccctgtctctacaaaaataaaataaaataattagccaggcatggtggtgtgcacctgtattctcagctacttgggaggctgtggtgggaagatcacttgagcccaggaggttgagactgcaatgagccgtgatcatgccagagcactccctgtctctaaataaataaacaaacaaataagtaaaggtagaatccaaattatggaatgctttgaacgaatgaatgaatatagaattcaaattatgcaatgttttccacctttgtattcatattgcctttttttttttttttttgagacagtcttgctctgttgcccaggttggagtgcagtggcatgatcttgttctcagctcactgcaacctccacctcccaggttcaaatgattctcatgcctcagcctcccgagtagctgggattacaggcatgtgccaccacgcccgactaatttttgtatttttttttaagtagagatggggtttcaccatattggccaggctggtctcaaactcctgacctcaagtgatccgcccacctcagcctcccaaagtgctgggattacaggtgtgagccaccatgcccagctcatattgcctttttgataggagcaatattattttcctttacccctttatgtccatgaagcattaaacaagacttacttcttcagtaatgttttgaaaattatgccttttggagaagtcatctacaggttaattataaaaatgtaactcattcatattaataaattaccacacagttgtaagtagtactttgaattgttgggtagaaaaagatcacctggaggctattcctcatgggaaatattaactaggtctagaagtccccttgccataaactttctatctcatactggagaagaatggattgttctcagaagaatgggttgtcctcagtgggaagacctgcatgcagaagtccccaggtcccctgctgtagtctccgtgttaccagataatacttaagaggactgtgccttggatacagggaggcaggtagtatggggaaccttgggcccagagaagcaggtgacccccgccaaaggagccctgagggctgggtgggaggggttttttatgacaaggagttgttgatgaaaaatgtgtgatggacactggacttccagtcactaccctttcagagtcgaaaatgaataggaacctatttaaatctttctttaggatcttgtctcagggtgatcctgctagcatttctgttttcttttctctttggtgtgagaaggctggggagagttttgtagggaacatgctgctaaacattgctttctggagttgtaggaatataggctttccccccactgtactacacttgaatccagccgctcgctcccattttaagagtgggaaagtgctgcatctgggccaccacagactctgttgaggtgtgaatgggagttcttttgcatatcccaacaaagaccccagttttaggaaaggagcatccctgaagttgagctgcattctagtgtggaaagagggtttttccagataaaaggggcagtggttagagtgaagatgaaggaagaaggaatgacagaaggggactgtgggaaagagagaagaccctgggaaggagggaagactgtggggaaggatagcaagattgtgggaaagtgagcaggactgtggggaagagagaggagggccctgggaaggaaggaggactgtggaaaggcgaggtggatggtgggaaagagggaggaggaccctaggaaggaggactgtgggaaggggagaaggatcatgggaaagagagaggaggaccctgggaaggaaggagtactttgggaaggtgaggaggactgtgggaaagagggaggaggaccctgggaaggaaggaggactgtgggaaggggcggaagactgtgggaaagacagaggaggaccctgggaaggaaggaggactgtgggaaggggagaaagaccatgggaaagaggtagggggaccctgggaaggaaggaagaatgtgggaaggcaaggaggactgtgggaaggggagaaagaccatgggaaagaggtagggggaccctgggaaggaaggaagaatgtgggaaggcaagaaggactgtgggaaagagggaggagggccctgggaaggagggaggactgtgggaaggagaggaggaccgtgggaaggagaggaggaccatgggaaagagagaggaggagcctgggaaggagaagggactgcagcatcagctccagttttgagggtaggtcgtattttgaacacctttaatgtgtcttgttggcctagtgtcacctgattttaaaccacaaatctacagattcagagaactgagttggaaggcactgagaaagcctatggaatttgctcatagcatagggctggcgcgctgtcagtgactgtggagggaaccagggcagggaaatgcagtgtaggaactgcccacgcgagagctggaacctgaccctccccctgctcggagaggactccttgctgtgaaatggaggtgatgtcttgaccagaaggtctccgcattgccccacctgctctgctttgggctaggccagtgtgggcatggcagcaggctcctgtcctgtggcttcccatgggctttggctcaagggaagccctggtgggagatggcagggagggatgcgagtgagattggggggcggggggaggcggttatcccaccaactccctgctcatgtggattttgggctggccgtgtctctcatgggatgggtggctgctccagtcaggctcaccttcctccttacccctctctcctcattccttcaggtctgggggcttccttgtttcgagtccctggctaccaccttgggctttctttatacctcacccaccctgtgaaagagtattaatcccacttgagattaccctaattcgagtgggccatctgtttccttttgagaacccgactacctcatcggcctgttcagaggattaaaccagagaatgctggaaattgtttagcacagtggccagcccctcagtgagtgtgccacagtgctggtcactgggtgagggaatgggtcctctcctctgggcctgaattgccctgcgctcacctgctcaggtgtcctctagtttcagccggagcacttccagggaggggaagacatgctcttgagagatgcttgctctacctagggcagaaaggatgtagcaggagtggctggggctgcgctacttgtagctgtcacatttggcagaaaaagaaacttctattctttcagatggctgagtctattttcaagtcttcacccactggaaatgttttaggcctattattgaaaattcagtaggtggttgcagtggagttaaacaataaccaggactctgtagagaattctaaaagctgaaaatgcatctttaagtaatagtaatcatattggcataggtgtgcacttttgaaagtggctttatgcatgtcctatgtagtgtaagaataatgtgtccccagatggaattgggtagttttgtggaatgtctttctttttttttttttgggatggagttttacccttgttgttgaggctggagtgcaatggtgtgatctcggctcaccgcaacctccacctcctgggttcaagtgattttcctgcctcagcctcccgagtagctgtgattacaggcatgtgccaccacgcctggctgattttgtatttttagtagagacggggtttctccatgttggtcaggctggtctcgaactccctacctcaggtgatccgtctgcctcggcctcccaaagtgctgggattacaggtgtgagccaccacacccggtcaggaatcccatttttatacccacatgcctttctgtccatgttaccactgtcagagagcctaccttaagcattttcttttctttttttttttttttttgagatgggttgcactctgttgcccaggctggagtgcagtggcatgttcacagcttactgtagtgtcgatctaggctcaagtgatcctcccacctcagcctcctgactagctgggactataggtgcacaccaccacacatggctaatttttgtatttttagtggagatggggttttgctatattgcccaggctggtcttgaacttctggcctcaagtgatcctcccgcctcggcctcccagaatactgggattacaggcgtgagccaccatgccctgccaaacattttcttgattcatttagcagatccttattcagtatcccatttgagcgtggtcctccagagtgttgggattcgtatccaccttcatctcagtgctgtctcagtctctcaagagaaaaataccagccattcccctggtatactgagtagcaggccatcccattgttaagaagatacctgtgctttgtcagctcttgggctatttttcattatgcagaaatgtacccagctaggccacatgcctttttaggtttgtctctcttttatttagtttgtccttatttatttattgtaaatatggaagaagaatcttttaaaatctcccttctctttcttttctttctctctctccccacccatgtctttttttgagacagggtctcattctgtcacgtaggctggagtgcagtggcgtgatcacggcttactgtagcctcaaactcctgggctcaagcaattctcccacctcagcctcctgagtagttgagaccacaggtgtgagccaccacacctggctaattaaaaaaaaaaaaattatgtagagacagggtctcactatgttgcctaggctggtcttgaactcctgggctcaagcagtcctctcactttggcctcctaaagtgttgggattataggcatgagccactatgcctggcccccacccacttattttggaatacatttttctttatccctcccctttacaaaagtattcatttttaaggtgaaatttatgtagagtaaaatgcataagtcatatgtctatggcttgatgatttttttttttttgtttctacgtaagtgcgtacctctataaccaccacccagatcaatgctatttctatccctctagaaagttccagcatgcctataaaaaggaagggggaaatgtcagagtcgttggaaccagagcaactgcatcttgaataggggttaggtaaaataaggctgagacctactgggctgcattcctagacagttaggcattctaagtcacaggacgagataggaggtcagcacgagatacagatcataaagaccttgctgataaaacaggttgcagtaaagaagccggctaaaacccaccaaaaacaagatggtgatgagagtgacctctggtcatcctcactgctacactcccaacggtgccatgacagttgacagatgccatggtaatgacaggaagttaccctatactgtctaaaaaggggaggaactcgcagttccgggaattgcccacccctttcttggaaagctcatgaataatccaccccttgtttggcatataatccagaaataaccataaaaatgggcaaccagcagctccaggcagctctcggggctgctctgcctgtggagtagccattcttttattcctttactttcttcttcttcttttttttttttttttgagacggagtgcagtggggagatctcggctcactacgacctctgcctcccgggttcaagggattctcttgcttcagcctcccgagtagctgggactacaggtgcgtgccaccatgcccagctaatttttgtatttttagtagagacagggtttcacatgttggccaggacgatctcaatctcttgaccttgtgatccgcctgcctcggcctcccaaattgctgggattacaggcatgagccactgcgcccagcccctttactttcttaataaatttgctttcattaaagaaaaaaaaaaaaagaacagacagttccaccaagccttttcccaatgattcctctccccctaggaaattgatcatcatacattagttttgcctgtactagaattttgtataaatggagtcatacaatatatgttcttttatatatgactggtgcacaacaaaatgtttttgcgtacatcggtactttgttcttgctgtgtagtatcccattatgatgaatatcccataatttgtttaatattttgttgatggatatttgggttgtttccagtttgaggattttattgatagaggctctgaacattcttgtatgttgtcttatggacattagcactaattgctcttgcatatgcacacatgtaagagtggaattgctgctgtcactgactttcaacctgtagatttttctctgtgtaaagttgtggcttccattgggtgaggggaggaggtgccatacctgtgcctgaagcctcatttgcgccacactagtcaatttagctaatcagcctgaatcttgtcataatgtagccacctatgaatataactggtgaggcgtcctgatgcacagaacccaatctcccagtgatgatttgattattgggccccaggaactgacaaagactgatttttaatttatttttttattttttttagacagtcttgctctgccacccaggctggagtgcaggggtgggatcatagctcactgtagcttcaaactcctgggctcaagtgatcctcttgccacagcctcccaagtagctaggaccacaggtatatgccacctcacctgggtaattattttgtattttttgtatagacggggtttcaccatattgcccaggctggtctccaactcctgcgctcaagtgatccgcccgcctcagcctcccaaagtgctgggattacaggcgtgggccaccgtgcctgggcgggtcttgctatgttgttcagctggtcttgaactcctgggctcaagtgatcctcccgccttggcctgcccaagtgttgggattacaagtatgagccactatgccaggcctattatattgttaaaaacatacaaagaacatgtgtcaaagtttcgttgaacttatttaatgagggaactagcagaataacaaaacaagctcagtgaggatatgaggaactcagtggaaaaaaaaaaaacctcagtggaaaaaggaatgttcaaataagattgctaagttaggttcaaaactggttcatgtcttagagaacaataaaatctttacctttggggttatcatctctaccagaaaagaaaaaagagaaaacagcataccttatcatttttctacattatcttctgacttttataggattgtaaaatatcctagtagtgttagttaaatcaagttacattttcagagtcaggtgaccctcctggcgggggatgggggggagtgtttattaaaaatgcaatagcatgacattaaaaggtcacatgatcatcttttttgcctagtttctaagttttgggttttttgtttgtttgtttgtttgtttgtttgtttgtttttttgtttaacagaccatgacagaccataatatggggtacaataataggaaaaactaggatgatatcttaaagtcatttaatgaaaaaaaaaaaaaaaaaaaaaaaaaagactgcacttctgggacctcagactgctacctaaaacagaaagccagtcacctatttcaggtagatgtggactctttcacaggggttaattttcccatgttggatttaactaccagtatcttccttttaaaaccttaccctcagatccagacaacattgttctttagtcaagcaaagcatgtataagcagccttttcttctgagttctcctggaagggacccacagctattcattttcaaatgaattttaaaagaaaaaaagccttgaaactatagctcgggctgatgtgcatgtgtctgcctgctcttttaggggacatttgtctgttaggggacatttgataaagttcaacaggacacaggccctcaacattttgtagctcacagatagacatgtggaaggcaggaagctatgataggggttaaaagaatatgcttgttgatctttaaatttatctgactctgtctgtgaggaagtaagctgttttctctgcctgtttttgtatgtgttcggcaaaagtacattttcccctctgcctgcccaattgttgatgggtgaagtgtgtacacttgcagcttgcatgtcctatgtgtgctgagcataaccattctcagctcacttgccgtggcctcagctttcatttgctaggtgttttagatctctctttggcacatttagagcccattttgatatttgtttaaagtggttggtgaatgtggctgttcttttttgatccatgaggcgaaaggccagtattttgcctaattgtaccactccaagataaagctcacagttactttgttcttcttgatttatgaagggatcacaaatctacttcaacaagtgtcataaagtagagattttcaggttactgttctacattcaaagaccctgacatggacctctttaatcatatttcacttttctttaaactttaaactcaagggccattaattttgtgaattatatggatgattgttttcaagatgtttgtctctcttcacaaggtagcagtaatttttctgggtgtgttatgttatgttatgttatgttatgttatgttatgttatgttatgttatgttatgttatgttatttagagacagtgtctccttccatagcctaggctggagtgtagtggtatgatcatggctcactgcagcctcaacctcccaggctcaggtgattctaccacctcagcctcccgagtaactgggactatacacatgtaaccacctaacctgttttttttttttaaattttttgtagagatgggggtatcactatgttgcccacgctggttgccctcctgggctcaagtgatcctttcgctttggcctcccaaaatgccagggttataggcaggagccaccgtgccctgtccaggtatgtattataatgtgcagagcctcatcttgctcacaacatttagtcctggtgtccttgggcatgtgggcatctgctgtgtgttaggcaccagaggatataaactcaaatgagatggactgaatggaatattgtcacaaatgtaacttctagaggatgatagttttagctcctatgacctgcctttgggaattctgtgctttaaacattgttctacaaagatattctgtaaagatgttctggattaaaatgccacttgagaagtttctggctgaattcatccagcaactgttagaatgtgctaaatgaacctacagttagctttttggccctgatggctgtgttactttatggagtaataatggctgcattctattcaaggcttactggctgcctggcattgtatgtataatctacccatgtctgtctgtgtacagtgactaaaatttgttgagcccttactgtatgccaggtaggaaggaggccaagccctttccatgtttttttgtttgtttgttttttgagattgagtctcactctgtcacccaggctggaatgcagtggtgcaatctgggctcattgcaacctccacctcccaggttcaaacagctctcgtgcctcagcctctggagtagctgggattacaggcgtgcaccaccacgcctggctgatatttgtatttttagtagagatagggttttgccatcttggccagtctggtctcaaattcctggtctcaagcaatccacctgcctcagcctcccaaagtgccgggactacaggcatgaaccaccgtgcccagcccctttccatgcttttttatctcatcaaattcttctaccactctatgacaggtaactgaggcatatcagtgttaaaagccatactcacagtcacacaaactagtgaggagcaaagagagcattagaatctaggccaaccagctctgcaacctgagctcaagcgggcagcattatctgggtgtctgaattgtcctgacaggactgtgctcctcaccattattgtctgctgtattatgccttccccaagtgtccattcaggtggaatcatggtatttaacttatttctgtctgcattttaaataattctcttcaaaagttggccctttcaactcaaaagaacaacctttgcctggatttatgggcttgtgttgttttttcctacaaattctgaaattaaggcaattagggaaaatatttcgttattattaatttgtaagcacacgttgttttgcagtgttcagcaggctatgctttctaggagtttgactgtcttttctatcagtggtaaataatcaagatgtgtgactatccaattgttccccatccacggggccctcaaaaccaaccaattccagctcaaattattcttgaaactttaaacatacagttttctttcagaaaaacaatttctaaaactaacaactggaacctgttagattctgttgtgagaaatgttattccaagtagggtctggagtaattaagtacaagtgtgttaccaataagaacccacatcatttggtggtttcttcaggctttgtaactgttgtagtgcagaaaatgtggtggaggggggcggtcttgtgactcagggagagctgtgacctcagtgagttttaatcgcctgactgagttgatcgtggtgattatgcataatggaatcttattttcttaatggcaagattatcgaatcttagcttggaaagggactttaagatcatgtgttttaacccttagctttctaccagatcaaaatctaaaccatctgagatatcaccgtgatcattactggatatttaaacttgttaagcttggggctcccacagcgactccatgtcagtgtgtctctaacctggtcctgctccaggtgcactacgtcatcagaattttgttttgggggcaggagtagggatagaagccttagaatcttttaaaaagttcaggtgattctgctgcttgatctaaagcttgggcattcattttgcacaatggtaccgatagggcagtaccatgtttttaattctagtttcttttctcaagaacatgaattggtagctggtgacttcaattagaaaatattttcatcttatttctaaagtagctttatggataaagtattaatagctatattagtgaatatgtaagtaaacacaatcatgctggaaattattgtaaaagtttactacaaatacacaaagaacatagtgctatgtaaacagtgcttgatttaagtccattagaattaatacattctggctgggtgtggtggctaacacctgtaatcccaggactttgggaggccaaggcgggcgaatcacttgaggtcagaagttcgagaccagactggccaacatgatgaaacctgtctctactaaaaatacaaaaagtagccaggcgtggtggtccatgcctgtagtcccagctactcagaggctgaggcacaaaaatcgcttgaacctgggaggcagaggttgcagtgagccgagattgtggcactgcactccagcctgggcaacagagtgagactatctcaaaaaacaaaaaaaaccaaagagaattaatacattctaattgcggaacttctgtactcagtgattctccatcccactctatacctggtggtagtgagataggcacaatttctagcaatggtcctcaagattctactcttaagtccccacaacttctacatgtgatgagctatcactccagtgattttgttatgttatatggcacaattgatctttaaacagggaggtgatccaggtgggcctaacatgagtccttaagagcagagaactttctcctgtctagtggcagaagagaaagtcagaggaggacttgctgctttgaagagggaggggtcatgtaagaaggaaatgggcagcctataggagcagagagtagaccttggctggcagccaggaaagaaatggagacctcagacctacggccgcaaggtgctggattgtgccaacaacctgagtgaatttggaagtgggttattcttccaagccgccagataaaagtctagcctattcacatcttgatattggcctgtgagaccttgagtgaacaaagaatccagttgagcctatcgggacttttgacctacagaactgtgagataaaaaatgggtgtcgttttagataacccatggcagcattccctcctctgctggaatgtcgtcagtggagactgactggggattctggacttccatccccatcctcccactcagcagtggtaggcagctccccctccccactagagaatggggaaaatcttggagaggagggagctgaagaaaggaattaattaaaggaatattccctgcctgcattggaagtcctgggcaaacaactcctaacccacctgcatgtgaatctgactagaacaaacatgccaaaaagtttagcaatagaaactttaacacagaatatcacccaggttttcagaatgacctctaagtaacagagatgaagcagaccagaatagtactgcaagggctctgaaatcaaactatcgttaaaactgcagccaacgaaaatagcccaggatgtgcgtacttagcctcaatagggttaatgccagctaaaatttaaatagtatctagagtcttgtaagataataacccaagtgcccaaggtacaatttaaacaatcacttgtcataccaagaaccaggaaaatcacaactcgaatgagaaaagccaatcaacagatattaatactgagaagactcagatgttggaattatctgacaaaggttttaaagcatctgtcataaaattgccttaataagcaattccaaacactcttgaaacaaatgaaaaattagaaaatctcagcaaatcaataggttttttaaaaatggaagttattgaaccaaaaaataaacaagttaaaaagctcaccagatgagctcaataatagatgacagaggaaagaatcagtgaacttgaaaatagatcaatgaaacttacttagtctgaacaacagatagaaaatagtctgtaaaaaatgaacagagccttagaggcctatgggataataacatcagatctaacatttgggtcatcagaattccagaaggagaaaagaaggttatgataataaacaatattgaacgaaatgatgactgaaaactcaccacatttggcaaaaagcataaatcttcagaattcagaagctgagcaaaacctaaacaggataaacctagagaaatctatgccaagatacatactaatcaagcttctaaaaatgaaaggcaaagaaaatgcagcaagagagacatgacatatacttacaaggaagaatgatttgaatgacaatgaatttctcctgtaaaataatggagtccagaaggaagtgtacaacattttcatgggctgaaagaaaagaaagattaactctgaattctttgtctggtgaaaatatccttaaggaatgaagagaaaatgaaaacattctcagatgaaggaacactaagagaatttatcaatagcagacctatccttaaataatgcctaaagaaagttttttaggctgggcacggtggctcacgccggtaatcccagcactttgggaggttgagatgggcggatcacaaggtcaggagatggagaccatcctggctaacacggtgaaaccccatctctactaaaaatacaaaaaaattagccaggcatagtggcggccgcctgtagtcccagctactcgggaggctgaggcaggagaatggcgtgaacctgggagggggagcttgcagtgatccgagatcatgccactgcactccagcctgggcgacagagtgagactccatctcagaaaaaaaaaagttttttaaacataaaagaaatggtaacagaagaaactttggaatttcagaaaggagaaaatagcaaatgggtaaaaatagggagtatgtatagtaggccaagtatagggtatgtgtcattaatttttttctgttgttgttgttgagacggaatcttgctctgttgtccaggctggagtgtagtggcacattcttggctcactgcaatctctgcctctcaggttcaagtgattatcttgcctcagtctcctgagtagctgggattacagatgtgcaccaccatgcctggctaatttttgtatttttagtagagacggggtttcaccatgatggccaggctggtgtcaaactcctggcatcaggtaatccacccgccttggcctcccaaagtgctgggattacaggtgtgagccactgtgcccggcttgtatcattaatttttaaaaacatgtttgatggttgaagcaaaaattagatcatctggtgtggtatccaatatatattgaggtaatatgcaagaaaattatatttaagaggtggggaggatgtaaaagaacctaactggaagtaaggtttttacacttcactgaaataggaaaatgttgatcgaagtagtctgtgacaagttacatatgtatattgtaataactaaaatactctaaaaatcactaaaagtataactgtacaaagagatatactaaaactgcctatatataaaaggaaattctaaagaatgtacaagtaacccacaggaagacaagaaaaaggaaacaatgaaaaacagagtgaacaaacagaaaacaaataatacaatggcaggtgtaagtcctaacatgtcaatatgtgttttaaatataccaattaaaaaacagagatgatagataaaaaaaaaaacttgactcaactatatgctgtttgtaagaaactcacttcaaatatattgatataggcacgttggaagtaaaagttggaaaatacatactatgcaagtattaattttaaaaaagcaggagtggctacatataatatcagatagggtagaccagagagcaaagaaaattaccagggacaaagaaggacattacacaatgataaaagtgtcattccaccaagaagacgtagcagtcctaaatgtgtatgggccaagcaacagagctgcaacatatatggagcaaaaactgatagaactagaaaatagacaagtacacagttatagttggcaacttagcatctctttctcagcacttgacagaattactaaacagaaaatcagcaagggtatagaaggcctgaacaacataatcaaccaagaagttgtaattgatgtttacagaatatcctacacagaaacagcacaaaacacatttttttcaagtacccatgaaatatctgccaagttaaaccatatcctgggtcataaaactaacctcaatatatttaagggaattgagataataaaaaaggtgttctttgaccataagtaattaagctagaagtcagtaatggaaagatcagaaaatctccaaacacttggaaatcaaatcacacacttctaaataatccacaggtcaaagaagaagtctcaaaaagattaaacaaacacatagaactgaatgaaaatgaacatacaacatattaaaatgtgtgggacccagctaaagcagtactgagaggaaaatttatagcactaaagtttacattagaatggaggaatgttctcagatcaataatctaaggtcctacctcaagaaactagaaaaagtgaaataaaccgaaaacaaccagaagaaggaaataatgaagataagagcagtaatcattgaaggtgaaaacagaaaaacaacagagaatatcaatgaaaaagccagttctttaaagaccaataggctgggtacagtggctcatgtttgaaatcccagcattttgggaagcgggagtgggaggatcacttgagcccaggactttgagaccagcctgggcagcatagcaagacactatctcgccaatcaaaaaataataataataatcaaaaaattagctggacgtggtggtgcatgcctgtggtcccagctactcaaaaggctgaggtgggaggattacttaagcctgggaggttgaggctgcagtgagctgtgattgtgccactgcactccagcctgggtgacagaatatgatcctatttcaaaataaataaataaaaagatcaataaaatgggtaaacctctaagaagacaggcaaagatgaaaaagacacaaattagcatagtaggaataaaacaggtgatatcattacagattctgcagctattaaagggacaataagcgaatactaaattatatgtacatacatttgacaacttagatgaaatgaaccaattccctgaaaactacaaactaccaaaacttacccaaagtgaaataatgtcaatagtcctataactaactgttaaagaaattgaatttgtcatgtaaaagcttccaaaaaagaaatctccaggcctagaggtttttcgtcataatttccaccaaacatttaaagaattagcaccaattctgcataatcttttcgagaaaatagaagaggagggaatgtgtcccaattcattttatgaggccagtattaccttaataccaaaaccagatagtgcaacaaagaaaactgcaggccagtgtccctcaagaacatagacacaaaagtcctcagcaaagtattagcaaaacaatccagcaacttataaaaaaaattatatactatgaccaagtggggtttattccagatgtgcaaggccacttcagtgtttggaaatcaatcagtgtaatccatgatatcaacacgctatgggagaaaaaatcaaatcgcataatcagatcaattgatgaaaaaaattgacaaaattcaacgccattcatgataaaaactctcagcaaactaggaatagagaggaattcccccaacttgataaagagcatctacaaaaatgctgcagttagcaccatatttaatggtgaaagactgtatactctccccctgagaatggggaaataaggtaagaatgtctgctcttaccagtctcattcaacgtaatactggaagtcctagctagagcaactagttgagaaaaaaataaaagacatatgaattggaaaggaagaataacatcttatttgcagatgacgtgattctccagtagaacatcccaagaatttaccaagtaactcctagaataagtgagtgcagtaaggtcacaggatataagatcaaacacacaatttaatatttctagatactagcaatgaacatatggaaactgaaattaaaaacacaatgccatgtacagtctctcccaaaagaattgaaatacagttatgcattgctgaacaacagggatatgttctcagaaatgcattgtaaggtgattttgttgttgtgtgaacatcatagagtagtatacttatacaaacgtaggtgatatagcctactacacacctagccatattgtatggcctatcactcctaggctacaaacctgcacagcatgttactgtaggcagttacgacacaatggtaagtagttgcatatctaaacatatctaaatattggctgggcactgtggctcacacctgtaatcccagcattttgggaggccaaggtgggtggatcacttgaggtgaggagttcgagaccagcctggccaacatggtgaaaccctgtctctactaaaaatacaaaaatgagctgggcatggttgcctgtgcctgtaatcccagcaactcaggaggctgaggcacgataatcgcttgaacctgggagacggaggttgcagtgagctgagatctcaccactgtactccagcctgggcaacagagcaatactgtctcaaaaaaacaaaaacaaaaccatatataaatataaaaaatgtacttaatacaatagaagtatggtattataatcttatggggaccattgacgtatatgttgtctattattgacaaaaacaatgttatgtagcatatgactatacttaggtataaacttaacatgtacaggatgtgcatgctgaaaacaacaaaatgttgttaatagtattcaaagaagatctaaataaatggagagacataccatattcatggactggagtcagtgtggttaagatgttgattcccccaaattaacctgtagatctaatgcaatttctatcaaaattccagcaagatttttttttgtagctatagactagtttattttaagatttataaaagaaatcaggagaactacaatagtcaaaacattttgaaaacaattttgaaaaagaagagcaaaataggaatctacccaattttatgagttaactttaatagttatagtaatcaagacagtctagtattgacacaggaatacacatatagataaaggaacggactagagaacccagaaataaacctacacaaatatgcccaagtgactttttgacaaaagggcaaaagcaattcaatggaggaaggatagccttttcaacaaatgatactggagtatttggacatccatagacaaaaaaagtgaaactcggcctaaatctaacatcttattaaaaaattaactcaaaacggatcatggatttaaatgtaaaacataaaactataaaagtgttagaattaaacataggcaaacattttggggacctaggcctaggtgaagagttcttagatatcataccaaaaacaaaatcttttttgtttttgctccgttgcccaggctagagtgcagtggcacagtctcagctcactgcagcctcgacctcccaggctcaagtgctccttgtgcctcagcctcccaagtagctggaactacaggtgtgagccaccacgcctggctaattttttgtattttttgtagagatggagtctccctatgttgcccaggctggtctcaaactcctagactcaagtaatccactgccttggcctcccaaagtactgggattacaagtgtgagccaccacacctggccaacacaatctattaaataaaaaaagatcaattagacttcatcaaaatgtgaagaggatgaaaagataggttacagactgggaggaaatatttgcaaaccacatgtctgacaaaggacttgtatctagaatgtgtagagctctcaaaatgcaacagtaagaaaccaaaacaatctaatgaaaatgggtgaaatacacgaacagacattcactgaagagagtatgcagatgtaaaataagcacatgaaaagatgtccaacatcattagtcattagaggaatgcaaattaaaaccacaacaagaaattactatgtatctattagaatggccattaggatggctaaattaaaaatggtgataacaccaaatgctggcaaggttgcagagaaactggttctctcatatattgatggtgggaatgaaaagtggttcagtcagtttggaaaatagtttggcagtttgttatagaactatgtgcttcccataggatgcagcagttatacttttggacactcatcccagagaaataaaaacttaagttcacagaaaaacctgtacacagatgttcatagcagctttatttgtaataattgcaaattggaaatatcttgaattgtctttgagtggatgaatggttaaacaagttccggtccaaccataccatggaatactactcagcaataaaacagaatgaactcggatacacacaacaacttagatagatctcaggggcatcgtgctgtgtgaacaaagccaacctaagatgttacacactgtatgatttcatttatattacattctcaaaatgacaaagctatagacttggagagcagattactggatgccaagggacaatgacagggtgtggggaagactggtaccacaataaaggggtagcatgagggagttccttttgaagatggaatagttctgtatcttgactgtatattgattgtgatccagtgtgtagatttgtgcaaatctacacattggatcaagttgcaaagagttacacacaaatcagtgtatggaatgactgatgaaaacggaataaggtctgtagtgaacagtattgtaccaatgtcaatttttttgttttgatattgtactatagtcatatatcatcactgagggaagctaagtgaagggtttatgggactccatgcaccgtttttgtaagttcttgtgagtagataattacttcaaaataaaaattaaaaaaaatctccaatgggtctcaaccttggcagcacacaagtatcgcccaaggagctttaaaaatcccgatgcccaggctgcatcttagtctcatctttatctctgattgtgagtctcagcattagtattttttaggatttctaactcttgtccttgttgttttccattaaattaaaaaaataataaccaccaccaggaccataccactttcccatacactgcagttctccagctctttgtgggtgatgggtgatgggtgacagattacaggtgtttcagttctttctcaggaggtcagactctgtcatcctgttgtcatgtctgaggctgggatttggggaagccccacccccagctttgagcaggtccaaggaggcattatcacttggcctgtctgtggttggcctggagactggagggccaatgacagaagtagagttgggaggagaaaagaaggatggaggaagagagaagtgggggtggagtgtgagaggatgtgggcctcagagaccctgttgagcctcaccctgggcctagtctcttggagcaagcatgtttgaggaggagaaagaaggggaggggaagatgaatgttggggatgggattgcaatttatgatagggaggccaggaaaggcctcatgaaaaaggtgatttaagtcaagacttgaggatgtgaggaagaactttgtggggatctgggggaaagagcccttcgggcagtgggaacggcacgtgcaaaggccctatggaggagggtgtccctggcttgttggaggaacaacagagagaccagtgcaccaccactgccggagggaagagggcaggggagagcaataggagaaggggttagaggacataggttacagggctccagatcagggagggccttgtgacttgtgactctgagtgagatgggaagtaactggggaggctgatgcgaccagagatgttttaacaggttccctctggctgccgtgttgagaaaagactgcaagggggaagggtggaagcgaggagagcagtttggaggccctttgcaggaatacaggggagaccagggggtggcagtgggagggtgagaagtggtcagattctggatatttctgtaagtacagccaacgggatttgctggtaagactgggggtgtggcaggagaggaaggagggagagatgactctaaggtttttgtcctgtgcattgggaagcatggtagggatgtgggtctggagtgtgggggccaggtccaggctagagataggaatttgcacagctgcccggctgtcagcccaggcccaccacagaaccacctctggcactacaattcctgtttgatgcaaggatggctgcttttcttacctgtcaccctgtgatgtgaaatcatgcatttagagcaacttggtaaatattaatttgtcaacaaatattagctattaatatcagtattaagccactccaagacactggagaaatacttagatggtgtttagcagtttggtactgtaggattcggatgctgagatggagttaggagtagaggaggtttgtttgggggctggggggataacacccttgaaggatgagagagcagaggagcagggcagggagagcctcaggtggtgatgccagtctgtcctggccagcctaacagggggcttctggacaaaaattgctccatgaaagcaaaggggagatgctagccaaagggcacaaacttgcaattacaagacgagttctggagacctgctgtgcagcacggtaactagagttaataatcatgcattacatacttaaaatttgagagtaactcttgcgtgttcttattacaaaaagggaactctgtgaggtgatgagtctcttaattagcttgattgtgatcgtcatttcacggtgtatatatatgtcagatcatcatgttgtacaccttatattaatacaatttttctttgtcaatcatacctcagtaaggctggaaaaaaaaaaaaagaaatgggcagaaatggccaggctctaggactgcactccccagattagtgaccagctgttggctcctcagcgagagcatggcctctgctagaaagaaagctgaggcagattccaaaggtgcaagttagttctttccttcttcttcttcttcttcttcttcttctttttttttgtttgtttttggagacagggtctcactctgttgcccaggctggagtgcagtggcgcgatcatggctcactgcagcctcgacctccaaggctcaagtgatcctcccacctcagcctcctgagtagttgggactacaggcgcgtaccaccacatctagctaattttttgttgttgtcttttgagacagagtctctctctttcacccaggctggagtgcagtggtgcgattttggctcacagcaacctccgcctcccgggctcaagcgattctccttcctcagcctcctgagtatctgggactacaggcgtgcactaacacacctggctaatttttgtattgtttgtagagacaaggtttcaccatgttgcccaagctggtcttgaattcctgagctcaggtgatccgcccaccttgtcttcccaatgtgctgggattacaggtatgagccaccatgcccagccccagctattttttttttttttttttttgtagagacggggtctcactatgttgcccaggctggtctcaaactcctgggctcaagcaatcctcctgcctcagcctcccaatgtgctgggattacaggtgtgagccactatgctggccaagttctttcttgaaggaacatatgggcagtacatctttagggctacccagaagacattttgtttcactttagcttcttaactcacaaagggatatgaaatagtatattgccccactcgcaggctaaggggtaaatttcatcatctttatgccactgagggagatgagataaattcttgaggagagttcagggagagtgaaggtgaagatgtgaaagtctctttaatgtgtagtcacaacatgtactagcacaaaagtcacacaaacacacagttatttgtggaatgaggtgtatgaagtcagcccgtttttgctcttagctgtctattttgctcgtcatgaaggagagcttttcattattgtcatacttcctctgggaccaccaggattttctcatgaagactaacaaagagatgatatcatgtgtctgggagtcagggtgaaaaacaaagtgggcttgcctgagtttgtaagctgagaagttgtccgagtcaaaccacatcctgccctgggtttctagaggcaggtggtcccagatggagacccagagcgggaggaactgtgccaatgctttcctaagagccatgctcagttcccaggaggtgtgggggaggccctggtgactatgtcctctttacactgaagttttcttctagggaggccacaactcactggttgccagtaaaggttgtgaagttggttccagttccagttgtggctgtgctgtgaaccagctgtgccactggtggccatgctgaagctcttggggttgtacttttcctggctgtcaaacgaagccatggtcaaggtctgagatagctagtgcaggtaggtagtatcggcgcagtgggggccaagtcaaaaccaaagagggactgtttttgcgtatcatggaagaaaaagtaaattaacattaaaaccatgtttaaaatatttattagatgtacattttagttgtgattatactacaacataattggaattgatgaagtattaacatgtgaacatattcttagcaaagctggacatgtttggagagtaccttgtcaagagtgtgatgcctgctgccgaaggcttcggtccagtgggatttgctttctgaccagataagattttatctaagagacaacatccaaaatcaataggctgacagattattggtaaaagatacattacagctgtttaaaaccataaacgctatcaagttctaactgctaagcctgtagtcatattgtaatatcgggaccctcatgggcacagatatgaaaggaatcaggatggtagctgtcgttctgtaattgctgtttaacagcctggcttatattcatgattcaatctttttttgtttttttcttgcttccacaattcaatccttatttctgtaagctgcaaaatcgtgagtgtgcgcacaagtttttttctcccccggtcttgaaactggaataattgccaatctgcttattaaaaaaatacatctgccctatgaaagtagtttcagctactctgtgttaaatgagtgattatgacattgggctctggtggcacgtaatactaatgctgaaacgcttgaatatggaggttagtgtggtttcagatgttgagaaatcacttctttgtgcttattgacatttttccaaggactgctctgttatttggcttaaaatgtcacatgacagctgatctctttggtgcatataatccatgcaattatagtgtgagcttctgctgtcagtggtggttaaaaatccatatacctcactccttttttagcctctgattttttttaattcaatttaactcatccttttattttaaaacttgaatttgaatgggttccattaacagatattttaaggtgacaatcaagtctagggcgctgccagcttgaagctgaacacagtccctagccctcaagctggatgtgagatctaatttagggcatgttgcaatgcagagatgtagctgatttgtaaacagcccttgtgacaacgtaatacagttgacaagtgatggttctcaggcagggtgaagtgtgttatctagctgtctgagtgatcaccctgattgcagttccacctggggttcatctcacagagccacacaggataattaaagccacagattcatcattggtagattcagcccattttagtctcattacagacaaatttagtcctgtcttcattcattataatgaaagtcacacgaagattcactttactataaactatattctttttcccttttaaatggaacgtacaagtgaatgttaaagtataaaagtacttgcaagtcactcgctttgctaatgagaatgtatgcaaatgtggtgcatgtttgcctttcctggactcagccctgtgacccatccctgtgtctgtcctgatggcagggattggtagataacttatgttggcccatctcttcccagagtggctagaatggtcttacggacatagaaggacatgttaaatattcatctggtttaattgaatttaatacacaatccttaagattaatctgcacttctggagttattaaatggctcactttttagtagcatatcatttatttgctattatctgagatagtgaattatttaagtaaaaagggaatgttctttccatgaggtggatcttaccaagctgctgctgctttcatttacaggcgattaccaattatattaaattaggaatgtgggtaaaaggaagcatggccgtctgaaggtttaagatgtttggttactaggtgttgcataatgtactgcaatctgggatctggcacttgctggttgacctatggtctgctggcacatgcattattaattatcgttttccatgaatattaatgatggttggatatcagtttaaagaatagtgaatcaattaacatgtaattttcatatactttgatttataaacatgcacattttaagatacatttgttttcttttagaacattaatttttccatttcagtttctcctttcccttgatactgactttttttttctttctttctttttttgagacaagtcttgctctgtcgccaggctggagtgcagtggtgcgatctcggctcactgcaacctccgcctcccgggttcaagtgattctcctgcctcagcctcccgagtagctgggattacaggtgcacgccaccacacccagctaattttttgtattttagtagagacagggtttcaccatgttggccaggatggtcttgatctcctgacctcgtgatctgcctgcctcggcctcccaaagtgtggggattacaggcgtgagctaccgtgcctggctgatactgacatttaatggtgtattggagtgatttatattttttcaggacaatttctgaagcgttgccaaaaatgctggttgtattttaaaattcaggtgatttctgtaagttattgaacaagaaccaagtgctgtacacatacctcagtctatttatattatagtactcttttctaccatggccacctacaacttaattttataatttgaaatgttactgaaccatgaaaatataaaagagcatataaccaacatctagctacccactacctagttctatcaaatgttgccattttgtcatacttacttctgatccttaaaaaaataaataagtagacttctgatttcagctcagagatgtagagagctgcaaagatgtccctcccacgcttccaagaaaaaatctggacagattggaaattaacagagaactgagtttgcagagcaaacgaccatttcaaaatctggaaagaggtgccttctgagacacaggacaggacctgagcatttgtttacaggagcagaagccaccagaccccatagaagtaggtaggaagattaagctagaaaatttgacaaattgctggaggctgagtgtgggctaacttgagagtgtgaagtcttgagggcagcagttgtgggggagggggtcctatccctttgcaggcttttcttccaggaaccccatttggctctaactgggagggtgagggaaaattcagagaaaactcatggtgctggctcaggaaccactgagcaatctacttagacccttctcctttaaggagcaaaaggcttattctgcagaggaaggctatggtctgagggccctggtgaattaaccattgcagatgggggatggagctccccttcagccccttccccactccatctcacctaaaaaaaaaggtctttaagcgggtggtagactgagaacattggtgatacctgctacagctgggggtttggggtgggaggagctgtatccctagggcaaatacgttgtgaagcctacaccttcaagacacaggcccgctgtgtatattttagagactgagacttgaaatattagagaactgcccttcttccctcaccccacctgcaggctagcaagcccccaggaataacagtgggttacagcagggagagctgcaagagacaggctcacactgggaacagcataaaggaaagccccaaagccaagagaggggacaaaaaaggtcactagaggaatttgaagtttttgatgttcataggaacaacaaacctcaacgcagctcaactcctgactagattaatatcagttccacactaagggctcatttaccttagtatctgctaccttctatgaaatgtctggctttcaaccaaaaattacaaggcatgccaaaaggcaggtaaaagcagtctgaagagacaaaacactcagtagaaccagatgcaaatgcgatatagctgctgcaacgatcaaaacacacatgtatcttacctagctctgtccactgagtgccctttctgtgacaggtgccattttaggagccatttcagaatgagcttaacaaggtctgagcttttagagagcttacactccaacagagtacagagagcttaaccacagacaagtgaaaagataattatagatagtgaaacatgcagccatgaagaaacacaggagaggaaaaggctagagtggctagagtggctggtggagtgtgtgggctgtttcaggtgaggagaagttggagcccacacgtgaatgatgaggaagaggctcctgccattgctaagagccatccaagcagagaacaagaagcataattgcccagaggcgtgaacaaggttggatcctccctcggtctgcactgttgccttggaaggtaaaaacgctatgggcatggtgctgattacagcaagctttacaattgtgttgctgtcatggccaacctctagggataaagtggtgggtgagttttctttaaacatgtgtaagaattacctgtcttcctccattttgagggacaaggagaatctgttagatcttgtttgtaaccacttcaggacctggtacagggtgaaaaggaatgtgaatttgcaattgtgagtagatactgcatcatttatccagtgcaactgtattgttctttgtattaactcagctactccttaccctccatcccttgccccaagtagtgattattcctatgttatagatgggaaaactgaagctcagagaggttgcctgacttgaagattgcagatctattaagggtcaacccagttatttgaactctggcagcctgacttcccaggattgtgttgtgagaactaattagaaggacaggtattcttaaaagtggagcctctgatgaaaaagaaaaccgaaaaccaaacatagttgtaaaattcacgtactaagtttatgtgaaaacattggctgctgaaactgcctaaggaaatggatttagtaaatgcatgttgaactatctatcacttgttcatttgtcatgagtgcttaaaatagatgaaaatgggtaaatagttgcaacgtcccaatttctgctgtgtcttactacacagcagaatactatacagtgttattgtatagtattaataccgtgagggcaatgttgtctgacacttccctacctggaacattctggaaatcactttttgtgatctcaataactgttaagtaattggtaccagtctagtgggttgttttgtttttgagatggagtctcgctgtgtcgcccaggctggagtgcagtggcgcgaactcggctcagtgcaacctccgcttccctggttcaagcgattctcctgcctcagcctcccaagtagctgggattacaggtgcacaccaccatgcccagctaatttttgtattttagtagagacagggtttcaccatgttggccaggctggtctcgaactcctgacctcaagtgatccacctgcctcagcctcccaaagtgctgggattacgggcataaactactgtgcctggcccagtctactgttttgtagactgcatttttcacctgctcaaatgcttttcatactttttctatagtagtgtttattttttgagaagatatgagacataaaataaatgaaccatattaagtacatgactggagagggagactgttacattggattaagaagatgcttgtatccattggtttttgtttttcaccattaggggaagaaaaacaccttcccaagagtacctttcttgatacaccaaaaggttgctggtatttggtaatgatatattcattgagggaaataccaggtgaatggagagttcttcaaccattagcaataactgagcacccactgtgtgcatagttcctttatctgtaccattcatgggactgcatgttagatgaggaaaacagcaaacagcaaatttttatatagcacttcccagggaccagagacattaagtaagttgcccaagggagcacagattgtaaatggcaggtctcgacgtgggctggtgggtggcttaactccagagtctgtgttctctcacccctaattgtactatggtatagcattgtctgggtggccttggctatgttcacaaacctcaaaccagacggtaattagcatgaggggcacccaaatctgtcaggttcggagaacttctgggagtcttggctgagctctgtgatagggtactgtgaggtgtttttttttttttttttttaatatgcagccatgtcttaattgaaaccacaacttcctgtggatgccttatgatgttatttgaacaagggaaataagcacatgaatctttaaaaagtttcaagtatgttgatttttaagaatggatgcaattagtagttctcattagctccacaaattatttaccgtggaatgctttggttccacataaagccctttaacgctaaaagattttgcaggttctgctgctttgactatctagagctgatttcgactggcagctttaaacatgcgcagtaatgcaagtgccgatgctgccagcacaaatggaacaatgtattgctttaatttaaaaaacaggctttgtctcatttttgactccctttacatttaatctgactagtcatgttttctaggaggatggtgagggtgagagcaggatttgactctgttgttcatcaataaagatcctggaaaaaactggaatgtgaattttgattgtgccctcccatttgtaaaggggaaacaaacaaaaaacaaaaaccctagaagattctgaggccagacgacagtgtagccttaggctgcctaaactcagatgtgcccttcttcctaggatcttgttaaaaggcagattgtgatggcagcgggtgggggggggggggtagggtttgggctgggggcgggtaggtttggggaagctgagattctgcagttctaagaagctcccagtcgatcctccttttagtagcaataatttctgacactttagacctagctctctatcttctggctgtgtggatcacctgggggagtttaaacaacacagtttctcacagccacaccagacctattgaatcagatctctgcaggggtgaaaccagcaggtatttggggaaaaaaaaaaaagctatagaaatcatttgataatacatctgccagctttgtttattggggatgggggagtaatgacagctttgaaaacttcactgttggaatcagattgagatgtttaaagttaagctttttgacatcctaagggcttccactccaaaactacatgagctatcttagcagccacccatcttggaagggaactcactagttctttatgagtatgtccaaactggcttagatcagagagagtggaggaaaaaaagagtacttaatggttagcttgctgacctgcctagcattagataatgtctgtgaaggcccctggagtgcctccagggaagccggggcccaaatatggaaaagagaagtcatgattatgaggtaggagttgcaattaccatcgtgaatatttaaagtgttatttcagctctttcctacgctcctgggtttggggtttcatttctttttcctttttttttaatatggattctcactctgtcgcccaggctggagtgcggtggcgcgatcttagcctactgcaacctctgcctcccgagttcaactgattctcctgcctcagcctcccgagtaactgggattacaggcacccgccaccatgcctggctaattttttgtatttttagtagagatgaggtttcaccgtgttagtcaggatggtctcgatctcctgacctcgtgatccgcctgcctcggcctcccaaagtgttgggattacaggcgtgagccactgtgcccagcctggggtttcatttctagcagtgtgtggggagccaggacaggttagaaagaagggccaggggatgtctttgttgtgataaagcagataccaccatggagttttgccactttcacggtatgattttattttattttattttttttgataactgagacaccccagcaagtgtcttcttaacatttcgtaaatcttactattaatcttttcccctgaggtcaagcaggaagataagacaccaggtagagacttagctttcgccctcctcaagctattgtgtctctcttttaacttggagtctttctttaaaaccaagtgtttcccagtgttgcgtgtgtgacttttcttaactccttacattatctaaggattaaaaaaataaggggctgggtgtggtggcctatgcctgtaattccagtgctttgggaggtcaaggcaggaggatcacttgagaccaggggtttgagaccaacctggccaacatagcgagaccttgtctctacactaaatttaaaaattagccaggcatggtggtgtgtgcctggcttggcacttgggaggctggggtgtgggaggattgcctgagcccaggagttagagaccagcctggacaacatagtgagacaatgtctctaaaataaataagggaaacctcacaatcagaaaaataaaaaaagttggacattccctgtcttccttttctgaagcttctacggtgagagatgttgtgcattgtcaccatgaacttctgtgtcagggagggttggagccgagaagcagagcgctaagtgtgatctggataagggatttcctgcacgttgtggaagctgccagtgcaagctgccccctgtgtcctgtactgagtctgaagtcgctggaggaaggtgggtgtggatgagagcaaggactcctggaacctgcctctggctctcacgcccccaacctcaatgacacagtgccctgtgggagagattggtgcccttcccgaaagagaaagattagcccagtccagtgggcatctgttgagtgtctgctatgtcttgagagctgttctgggccccgggggagagcatgaggggagagactgacctggaagcacacttttccaacccgttgtggtgcgtgcccagtacgctaagggagcacaaagggagggggacctaagagcctggggcagaagaggaaggaatttgatcaggtgaagaggacgggccagagcccagagcgagtgagaatgagggtatagtgtgagtgtgaacagaggcctacagcttgatgagtacctagaaataagccttgccagagtaaaatgggaagcaaggccagaaggtgagagggatcttgcacgcccttgaaaggaacttggacttttggggtaattgggaaccactgaggcaggattctaagcaggggtatgccgcaccgtcacatgtggatggaggaaagttccttcaatctgtgacctctcctgaatgagcacctgctcccaggcaaggtttttatttatttttattttattttaatattttggagtgcagtggtgcaatcttggctcactgcaacctgcgcctcccaggttccagtgattcttgtgcctcagcctctcgagtagctgggactacagacatgcgccaccacaactggctaatttttgtgttttcttggtagagaccgggtttccttgtgttggccaggctggtctcgaactcctggcctcaagtgatccgcccacctgggtctcccaaagtgctgggattacaggcatgagccaccgcactgagcctccaggcatgttccccactggccacccctccccgagacagagccttgctctgtcgctcaggctggagtgcagtggtgtgatcttggatcactgcaacctctgcctcctgggttcaagtgatccttctgtctcagtctcccaagtagctgggattacaggcacctgccatcatgcccagctaatttttctgtattcttagtagagacagggtttctccatgttggccaggctggtttcaaactcctgacctcaagggatccgcccacctcagcctcccaaagtgttagaattacaggcgtgagacactgcacctggcccaggcaaggttttagaaacagctttgaggtctaatttacatgccatgatattgacctaatgagtatcccagtcagtgctttttaatatatttacagagttgtgtgaccatcttcacaatctaattcttgaacatttccatcacccccaaaagaaacctgtgcccatttgcagtcactctccatttccacgctcagccctaggcaaccactcacctttgtaatttctcctttttctttaaggagaatgttttctgcaaatgtattatttactttaaggagtctcccaaattataaactcttactcttggctacccggttagttactgcttagcctgttcctcccagcacacttgagattgcatggaacagaaacctgtctgggactgccttaaacacagacatttgttattttgcataattgggaggctagaggtagggtggaccccaggggcagtgtgatcagctgctcagtgtgacatcagaaacctgtgttcttgctgtctcttcccccaccgtgttgttctggcagtagcttcacccaagggctggcttccctgtggtcatcagatggttgtagaatggtgtccatctgcagtggggccctttgcttccttgctcacagcccgtatgtaggaggagttatttcttgcagtctgattgggtgagctttgttccccctgcccaccctgaagcaatgattggcttagaattaattaggctgtccttcctagagctggaaatgggctccatgggggaatggatggcacctgtgaccaggagtgggctctgctggggaaggaggaagggagccagctctactgggtaggcaaccagcagtgctcactgagggttcctgaccaactgcattggattgtttgtttcctttcacttgggggccttttttatgttaaatgcaagcaaggtgatcctctgattttgaacttgttatctgggggaaggcagaccaatcccagttcatcctggctgagtgacagcggatttgatcgttgatctcaataggcttgagagtaataatatgtgagtatttttgaagctgaccctaactttacatctctgaaaagtatcaattcagatctcactaattcaggaggttctgataatttggtcaagaagttcgctgaagtttacctttgaacagttttatagtgagggtaatattggtgatggtggtaacactaacatatgtgggaaataaatgatttgagtaacattcgaaaaacctgtttgctttaggatagaaatatctaaatatacgactagaagtaaatagtagaaaatcattcctatctagttattaacttagtcccttggaatctctccttggggaaaaaataaaatcctgctctgactatgtcagtatttgaattactgtatgaacctgaaattaacaaaaatggactttcaagtataattcatgcttcactgagccaaatagacattctgccagttatttggactttattaaattttactttattacttatatgtaataaaaaatcaaggtaagcctctgctttgcgaagtcatttatttgattaggagctgtattttagagtgcatttcagggcgaggtttgtccacatgtaagtaatgaacgtttgctggtgcagctcgtaatggtgagaacggatgttgaagaaagcaaacaccatatgccctttgtttcccgtgcatgtcctcttctggaggcctgggtggagtgtttcagctgtctcaaataatctccattttgctgttactgcagactctgcggttctccagctctctcctctctgatgttaattataacttcttcctaattaggtggctcttcctcctcctcagtcatacaggttccacactctcaagtgccagagattggattacttttcacttgatttgcgacagaaataagtgcaaagaattacaaaaaaaccaccagtgtgagtgtgtagtgggaggggcaggcgggttgggtacgggacaggatgcttagaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgtaagtaggccatacatctgttttgattgttgcgatgtctgcatcttttgtagcctgttgcccgactactttgtaggccaggagggaggcatgatggggaatttggtctcaggccagtccttccaagatggtgaccaacactgttttccacttggccccaggtctcagttttctggtttatagccgaagggtatttctttcactaagcccttgtctgtgatagaagtggattctttggctgagttccttttgtagtggcatttataaagattttgaatagctctgtcatctggtttggtggctctttccctctctgatcactatcgacagccaggtgagttttctccaggggacacggcacacagatagctgcattcaaccaaaccccctgcaggcatccatttctgcagtgaggtacccctctcaggggttgggagcaggtaacatttctgatgcagctggcagatctgggaatctaggggggaagccaggtgtggaatttagctttcctgtagtgtgaagaaataaagggggtgggggtaagaatgagatgggagacaggagagaaagtcagcttggggtctgtcaagagcactgtcctgttgccagatgccaactgaggtgtcgggagaggttcagttccccactcagctaactgtgcagccatgggctgctaaccaagatctctccaagtcttacttttctcatctgaaaatctgcatcctaccacctcgcaggactactggattgtttaaagtaatgaatgtgaaggcacctggtgcttggttgccatccttctccttttccatggcactctatgccataaatgcaagcagtgtgctgggctctgtgagatgccaccagtgttgctgtcctggcttgtttcaggccatcttttgtggccaccaagttctcatggtcagtgtcataggtttgatcttggggttggccagttggccttgcttaagtatgtagccccaggttgcccttttagtcatggccaggtgacccgcctcccaaaacaaggtcctggggaaagggtatgagtgagtcatggttatgtctcatagctaacgtttaagttaaagatgatgggaactgaggacccaagttaggaggctgtgttacaggtccttggggagagtgataattcaaaagacccctttcccgtccagctttgagtttccaacttattaaaacctatattcagccagagggagggagaaggaaaacaaaaggtaaacctcggccaggcacaatggtttatgcctgtaattccagcactttgggaggccgaggcaggaggatcgcttgagcccaggagttcgagaccagcctgggcaacatggtgagaccctgtctctaccaaaaataaaaaaaaattagccaggaatggtgacacacgcctgtagtcccagctactcaggaggctgaggctggaggattgactgagcctgggaggtcgaggctgcagtgagccatgatcacgctactgcactccagcctgggtgataggagtgagaccctgtgtcaaaaaaataaaaataaaaataaaccttgattgaaaactgccgagcagtcatctgaattctgattcagaagtacatgtaggacaccgtcatggtacttttccattgtgttgtttcatttaatgtgtttatgaatttaggcagccaccatgcacgtcggtcaagccccagttgcctttcgtgtgtgtgtgtgtgtgtgtgtgtgtgtgtgtgtttagggcactttctagagcctgctttgttaattaactgtactatgtgctttatatttgctgtgagttaattaccgatgatagtgttcccttgccagtcacaagttctctcacccctttcccccattgaattcctcatatttcatctcatccataggctcaagttgtttgtctttgactggcaagactcctcaataatcgtgtatcagtgatctctgacacagtgctaacttttatcactgattacggagagacattgtataaatcatcaggacagtttgttttgcgtatgatgatttaagagcacctcttaaccaacatcaaagtaatatatcagagtgccaaccttcggtacttttcttttgcttttcattgaaatccactttcttttctatggtctactgggcctcgtatggtctggctttgcctaccttttcagcctcatcggggtcatcttcccactcggccactgccttctgccatattgagttctcgcctgtcccagcactgtctctgcgtctggtcacttgcaattctcactgctgggaatgcccctttttttctttttggctccttgcttggctggccctttctcttctttcaggtaccactctgagcagccctccagggccatcttgtctcaagggccagcctccatcttgagtttcctttctccattcccatcacatcaccacatttatttcctttgcagtccttatatcacagcctgtaaatattttgttaactcattgatggacttggtatttgatgtctctcccaccagaattttagctccatgagggcaggggccttgtctgtcttatccctaccatatccccagctcttaactcaattctagatgcatagtaaatgctcaacagatatttgttgaatgaatagttgctttggataattaacacggtgaattacttttaagtagtttgtgactgcaagctgatagagccagtcccatgttttatgtggctggccccctccccatctgcatccatcactgctctggcactttgggagcatttcagaccccagggcactatttctctgtcttggccagcccctggctggtgtctgggataaccctctgttttaagcatcatttttgttctcaaaatgaaaaccacctgtcttcaacgtgatttgcttaaaataaatgctttatttctttactgagaccttcttccctttctgcctttctccacctcctgccaagaataatgtgaaaaaccccattatcttggaaagtggttttccctctggttggaatacaaagccagatgacttaccaccaaatgtgctgggataatagctttcccctgccctgatgctctcagatgttagtgaggtctcgaccttggcacttcctttctttgtatatttccttgaaacttccttcctacaggtaaagaagctagcccaaggcaccacctaaatggcagtgggggtagggaccatgtctaagtagcactctgtggcagactgtttgccagctcactgacaccttacaccaattccagggagttgacagtttttaccaccattttagagatagcaaaatggaggctcactgaggttaggtgacttgttcctaagcacataggttgcaaccagccaagatcagaaaccaggcttgtctgactcccaaattcatcttttatttgttgatgtactcagtgtctcccagggctatatcaaccaagttctgcagttaaaaaaacatctggcaacctggtctacggtacacatcccatgtaactgaggtaagtttcctgaaacagtagctgccttcactgtgtgtgatgccctcttgtattctccattccattcaacagatgcttgtcaggaccttctaaactgattacgtggcccaccgattggtggcagtccatttgaaaacagtttgagggacattagtgtaggtgaggtgtaaactatgcttagtttatatagaggtttacatggtgtaagctattaaaaagaatttttatggcaatataatagacatacataaaatgcgcatgagggtacggctgttgaatttttacaaactaaacacatctgcataattagcacgagatcaaaacacacaccattgatttaagcttctttgaatcaagacagaggcatgaagtacaacagaaactgatagcccctcagtttgttgtgaattacgcacaaacagcttactccataggcagactctttttggaggtccgtagcttgcctttccagtgatggggtctggctggtatttgtttgagatctaagaattgccgaaggagtggaatatggcctctgtaatggcctcagaaattagcacaaaaggagggctgactgagaatgtgcctcgtaaaatgtgaacatggaggaggaggaggaggaaagggcaaggccccgtagttgagtacagaaacattagggtgtgagaatttgtggtcatagtaattgagaccaattttactgaaatggagggcggcaaaaggaggaaggaaaaggaatttgtgattacagcaccaagcccctagaggttaaagaacgtctctgtaaaataaggaatatctacctctcatggtgagtgttgacttttagagaaaattgttctagtatactgaactaaaatgcttaattcttggcaaaagatacagatgcatctccatgcaaaagcaagctaaagcaactttgctttcataatgtatgggttctgtaaagctgtcttggtggacatgccatatgtaattcatcataatggggtgtgcatagaaatgaaagggagcgaatatcgtaacatgccttgaagcattgagtgctaagttacaaagggcattaattaatacaacttaatgggattcatttatagctcacttttagtcaaactgaaatagctttcctgaatcagggactttgggataataataaatccttttgtctttgttgatcagataagctcttattcactgacttcctgttactttcttggcacccagagtcatgcctgggcactaaggatttgctgaatgaatggaaggagtaaggacaaaaaaaatcgtagctagcatttaatgagtgtgtactgtgtgctttgcctcttttatctgatttagtcatcactacaaggctgtgaggcaggcactgttatcattttcttctttattttattttattttatttattttttgagatagagtcttgctctgtcgcccaggctggagtgcagtggcgctatctcggctcactgcaagctctgcctcccgagttcatgccattctcctgcctcagcctcccgagatgctgggactccaggcgcctgccaccaagcccagctaattctttgtatttttagtagagacggggtttcaccatgttagccaggatggtctcgatctcctgacctcgtgatccgcccgcctcagcctcccaaagtgctgggattacaggcgtgagccaccatgtccggcctatttatttatctatttattgagacgggatctcactctcacccaggctggagtgcaatggtgcaatcacagctcactgcagcctcgacctcctgggctcaagtgagcctcccacctctcagcctcctgagtagctgggactatagttgcacaccaccatgcctggctgattttttttttttttttttttttgtagagacagggtttcaccatgttgcccaggctggtcttgaactcctgggctcagtgatctgcctgcctgggcctcccaaagtgttgggattataggtgtgagccaccatgcccagcattatcccttcttttagagccaccttatttcctctacttgcctggggaccgttctggtgtatgcctgttgtcctcgcattaacattgacatcacctgctttcattctcagatgtcctggtcagatgataaaccatttcactctgaaatgttctggtttggatagacagatgaggaaactgagacacagagaagccacatcactttccatggtcaccaagctagtaagatgtaaaggtgggattctttcctgggagtctgattccaggtcatgttgtctgatcactaagttctggtgcttcacagtttaagccaagggagagataatataggaaaaccactctttatgtttttcagcttcagtatttagtaaaaatcactgccaagttagcatctgaagtaggttaatgtgactcagggcagtgggaatgtgctaggtaaagactcattgaaaccctaagtgtgtgttcattagtaaacttggccaactactaccctagaatgataatagcattcacatgtgcatggtgctttatagtttacaaaacctcttctcccatattattgtgttgaagcttcttgtgcactcagaggtgggaggtggatggccagtggtgggatttccagtttatagaggaggatggggtaatcagcaggatagtacagttgcctgcctgaggcttcacggctagaaaagaggcagatccaggattcaacccaggtattccgcctcagcgatcagtgcattcccactttagcacgggtgcctcttagccagatatatatatatatatatatatatttttttttccttgagacaatgtcttgcttgctctgtcacctaggccagagtgcagtggtgtgatcacaactcactgtagcctcaacctcccaggctcaaacaatcctcccacctcagcctcccaaatagctgggattacaggtgtgcaaccaccatgcctgactaattttaaaatttttttaagagatggggtcccactatattgctcaggctggtctggaattcctgggctaaagtaatcctcccacctcggcctcccaaagtgctgagattacaggtgtgagccacccatgcctggcccagatgctcttatatagccatttgagggtgctgtttatgaagggttagggagtcacttgaagactcatttacccagagtttcttagccttggcactgttgatattttgagccagttaagcctgttgtgggggctgtcctgtgtgttgtaggatgtttaggagcatctctggggtctactcgctagatgccaatagcacaatcgcccgtcccgcccctgcccccaccccccgcccccgccagatccctccaagtcgtgacaacaaaggaaagcgtctccagacattaccaaatgtcccttgctggggcacaattgcctctggttaggaaccactggcctaacataatagccacatttaaaagagggaaagacgaccttgaaaatgttagacctgtcttcttcccctttctctagtttctaaagcatcagaaaaactgttgaaagacctgcaaaggggcaaaatagagaacaagcaacatgtttcatgttgaattctcttccgtggaagagcattgtgtctgccaaaggataagatagccaacatttttttaagttaaaaatcacacagttaaaaatgttttgatagaaaagttagaatagagatcagccaaaatatacatatgcagaatctcctgtaatcctactgccgagataaccatggttcatattttggtctatttccttctaaccttttccagcatgcgtatacaagtatatattaaaaaaataattttccaaatagagccataccaaaagctgttataaacagctttttaatttaaatgtgccacaaatacctttccatatctatgatacagagttactaaggtttgtagtattttgttgtatggctagcatatagtttattcacttagtctcctgttgtgtacgtttggtttgcttctaattttgtttttgctgttaacatgcaaaaccgtggtgagtatccatgtgcatacttacaccctttccagcttattttttttccttctagaagttaccatcactgtaatttttagtatccattgagtaagatattgaattcatagtgttctggattgtattttaattatgtcacatacctttacccctcaaaattacggaaatgtattgattaaaaatgtgtttatgtgctagacttgcagaatggggtgtggaaagttctttggttttctgattgaacgatgactaataagaaaccatttgggtttcgtgccttgttcatgaagcccagtcttaactgtgtcaggctacttcctgagtaggaatcagcccagtgaaggttgcttaaccgtcctttaagattctgttcactactgaaagaaattcaaggctatatgctcgtgaattctcattgctcatggatttttcttctatgtgttttaaattataaactcacggaaaagacattcagatggtagagaagagcataaagtttcctactttactcccctccctcttggtttttttttttttttcattctctaggatttttgtatgcttgtacaaatattgaaatacaaaaaaatttaaaacccacaaattgggcaacagaatgcaatgtgtgagccaagtagcttttttctacttaatgcatctttctatatcagcaccttattctgtttaattggtgccctatttggggttgttttcagcttctcctgcaacaagtcaccttctattatgagtctatccataggatacatgcttagcagtggagttgttgggttaagagtttatgtccttatggttttgatagatattgctaaattgcccttctaccagcaatatatagcttgacttgtttctatcaggcatttttttcatgcctggcataaattattgattaataagctgggaacacaaaggtagaatctcatctataggaaggagcatagttggttaggagaccatgtcttccctaatgaccattatgagtattggttttcagccttgagcatactcagggggatgtgtatttactggtttcctcctggggttggcctgaaactggcttttacttttttcaaccacagagttagaatatgcatataaagttgggagacaatacccagatagacaactttctgggagtattcgatgacatgcctcaattagaattgaggtggttagaaatggacccttattactaaagaggttgtgacatgtaaatatcagtgggtctctgaaatagaagcataggtcatttggcatttggtacactgtatcaaatggaacataatataataaatgtaaatgtaacatgttataatcatgttacagtcattactacccctcttatctcttccatgacgtcttttctgatgtttcttcattccccatcttctcccactccaagatgactttttttcacactgtccttaaaaaaaatatagctggtactgcatttagggctttaaattgttttattatcttggatcagatatgtatccctaatcaaattttaaccaacacttggtttctggtcctcttcactctggctgggtgtttggaacgtaagtattttgattggttgtccactctagaattcttctgatttcatggggtccctgtgcttggtaaaggagggctctctcctggacatctcccccttgtaggcccccagaacggtgctcataaaggactctgtcatctcagtcttcagagcactgctttcctgcctagggaagggcacagcagggtgccatcttttatatgatttggtatctgaaggagcagaggatggtagatgtttgaagatgattctgtgaaccctggtgggtacggcagctgccagagcccaggtaaccatgtgaagggctcatattttctgaaaagtcagggctttctgatgggcactttttagggtattcttggccaggatttttttttttttttttgagtcggcctgaagtgtcctggaaggtggaagctaaaatccatgtaggtttggcctcaggctgggcctcttagaggaggtggggcagctttcatttcctttctccttgagccccgagggctgacactgtgccctggggactctccctggcctttcccaggggatgacctcgagagagtcttaaaaagggaacaaaccaaaaagctgttatttatttttcttattgttcagataatatattttcctttatagcaaatgaagagggcttttagggggcaggcagtgtgatctgaggaaaatggcctctggggtcaaatagttctgggttggaatgtgggctctgtggctttttccctaaggggctattatgggccaaattttgtccctaacccccctgtacctcataatgtgactgtctttggagataggtcctttaaagaggtgattaagttaaaatgaggccattagggtaggccttaatccaatctgactggtgtcctcataagaagaggagattagggctcaccgagagataccagggacgcagacgcacagaggaaagaccatgtgaggacacagcaagcaggtggctatctgcaagccaaggagaggggccccaggagaaacccaatgtaccttgattccagccttcagagctgtgaggtaatgaatttctattatttaagcccccctagtctgtggtattttgttatggcaacctaggctgactaagatgggggcttttagcaagtcaggtcccctgattttgctttcctaaagagggaccacaacaccctgagttgacaagaagagtggacacagtgcctggcttctaggaggtactttcaaatggcagtggtggtggtcaccataatcatttaataatatgataatagaaatcaccacccccttccctcacccaagttttctgaccccgtctggtttgaggtttttctttttctttctttatttttatttttatatatttttttgagatggagccttgctgtatcacccaggctagagtgcagtggcgcaatctcagctcaccacaacctctgcctctcaggttcaagcaattctcctgcctcagcctcctgagtagctgggactacaggcatgcgccaccatgcccggctaatttttgtactttcagtagagacctgattttgccatgttggccaggatggcctcaaactcctgacctcgtgatccgcccgcctaggcctcccaaagtgctgggattacaggcgtgagccaccgtgcctggcctctttttatttttttatttttttaactttccttttaagtccttttcaaagagggttgcaaagaactcatgtgatcagagattggtactttataggttgagtgaagtattttcttttgagtaacccttttcatccttttcatctgttaacatattggaggtccaggtaaaattgtatttaggacaaggattctgctgccaaaatagattcaaagtgactttcagcgtggtgtgaatatttactgtacctgacacccattgtattagtttgcttgtgctgctgtgacaaagtaccacatgctgtgagtggcttaaccagtggaaatttattgtctggcagttctggaggctggaattcagagatcaaggtgtgggcagggttggttccttctgagggtcgtgagggagagtctgctcctccccttgcttctggtggtttgctggcgatctttgggttgtagacacatcaccccagtctctgtcttcatcttcacatggcattctccctgtgtgcatatctctgtgtccaaagttcttcatttttgtgttttttttttttgttttttttttttttttggagatagaatcttgctctgttgctcaggctggagtgcactggcacgattatggctcactgcagcctccatcttctgggctcaagtgatcctcccaccttggcctcccaaagcgctgagattacaggcgtgagccacagctcccatcccaaagttctcctttttataaggataccactcatattggattagcgccactcaaatgacctaattttaacttgatcatctgcaaagaccctatgtctaaataacgtcatattcatggatactggggataaggacttccatatcttttggggagatacaattcaactcataacaccaattatattggaaccctatttgccatctgtgcacctctgcctgcgtccggcagcttctcaggagaagtccctctgcctggtctgccattcttgtttgccatgcagatttcagcgaagaagtcacctgctggagaggccttccctggccaccctcaatatagagtgattgaatgagtgaaatagattgcagagtaaaattaaaatgtgattgagaattatgctgagcataatttacccttaaaagtgtgagagaactcctctccaccccacatcaatgttacttgtaacttttttgtatatgttggctgtgtccccatcacagatgctatttaaatatcattttgtgcctgtgaattgagatgtcgggcaccttctgaatgtcatgatgtttcctattctgtgtgcagagcatgccaagaggattcaatttgttgaatttggatctttttttgcaatgagtcactatttgattatgattttacaacaattcacagaatcaaactggctagaccccttctctgaaggacatcttgggtccagaaaacctgtgaatcatgaataagggaaacatttactaatgctagttaattatcagtgtttgttaaatatgttctccttgctgaaactgctaggggctgtgcagaataccgaaatagaataggcaatagctgtggcctccaggaacacacaattcacatcaaacagccaaaaaatagataatacatgcaaagtggtgtgagaaggtgtagtacagaaattaagaagaagtgcttgttgtggaccagaaagatcaaggcaggctttgctgaggaacttagttaggcttgggctgtgccttaaagagttagagatcccaggagaggagggagaataccagctcaagacaatattaacataatatcattaagctgtataatagtcacagtatatattgaactaccaggttttaataaaaattttcttcacaagatagatatgaaatgatttgtaacagaaaaatattgtatacatcctaaatgtccatcaacttgggatatataagttatagtacatccatatagtagaatactctacagtcagaaaaaagaatgaggatgctttttaccgctgtggaccttccaaatatattattgttcagtgagaaaagcaaggtgcaggacagtgggtatgatatgctaatgtatgatattttcttaaagaaactagaagttgcctaagaaactaataacctatgtgtggtagtggtagactgggagaatgggagctagattctgtgtggggatgtttgtgtgtatgtgtgtgatttgaatgatgtaaatgtatcctattcaaaaagttaggtgtgaagacaatagtatttggtcacactgttgctacccttaaattgacttagtgctttgccttgctgggacataataaacgaagataattagtgacaccagatatcttagagataaacttttgcatttgcccagagaatgaaattcccttgaccagctttcacttttgttggccgccacaagaaaggtttgaagcatagcactcaatagaggggctggtctaatgaacccctttttacccatcgtctagcttcagcgttatcatctgctggccaatgctgctttgtttgttctctctcctcctcattcttcccttcttccctggccttgattattttgaaggcaatgccattctgatggaataatttagaattattactctgacctcctgagtcccaccatggccccagacatgcagagtacattagatgcttaggtgggaaaagctgtctttaatggaatttggctcatcacattaaactcatttgattttacttaaaaaaatgtaaaaaattattgtgcaatacaggtaacataaaatgtaccatcttagtcatttgaagtgtatggttcaaatagcactaagtacatgcacattgttgtgccactaatcttcagaacttttttatcttgcaaaactgaaactctgcacccatgacacaccagctccccatttccccttccccccagcccctggcaaccaccattctgtgttctgtgtctgaatttgactcctccaagtagttcatgtaagtggaatcatatatgatttgtctttttgtgactggcttattctacttagcataatgtcctcaaggttcatccgtgtggtagcatgtgacaggatttccttcctttgtaaggctgaatcatatcctcttgtatggatataccacattttgtttttccattcagtcattgatagatacttgggctaactttactttttgccccctcttagaatataaggttttatggctcataataatttcatgctgtagcacatcagaatgcctcagcacactattaccctccagttaagagaataattctgagcagtttgagaatatatgtatttttgagacagggtctcactctgtagcccaggttggagtgcagtggcgcaatcttggctcactgcaatctccgcctctctggctcaagtgatgctcccacctcagcctcccaagtagctgggaccacaggtacgtaccaccacgcctagctaatttttttttttttttgtattttttgtagagaccgggtttcaccatgttgcctaggttggtctccaactcctgggctcaagcagtccgctcacctcatcctccaaaagtgcttgagaattcttataccaaatactttgacttgaaaaaccagcaaattttcctttctgcttttgtgaccaagggcagcattttctctcaaagctcttacattgaattttgtctctcaccagactagattatgaatttagagagactagggcagggggtggggtgatatcttcatttgcccagtacctggcactgtgcttggcactgggtggatactgtgtatgtatttgttggaggaggagtgttactttgggcaaggcatgtacctatacctttataattaggaagttgaaccagatgaattctaagaccccttttggttctaacattgtttgggtccatcattaaacctgaaaatcccaggctgggcgcggtggctcacacctgtaatcccagcactttgggaggccgaggtgagcagatcgcttgaggtcaggagtttgagaccagcctggcccacgtggtgaaaccccatccatctctactaaaaatataaaaattagtcaggtgtggtatgcctgtaatcccagctacttgggaggctgaggcaggagaatcacttgaacccaggaggtagaggttgcagtgagctgagatcgcgccactgcactgcagcctgggcgacagagtgagactctgtctaaaaaagtaaaataaaataaaataaaaaataaatctgatgatgaaaatttcagactctctggaatactggagatttgggggaggtagtgaaatttttggatagacatattttcactgcccctcaaatgatacccagaggtggtcacctacaagtaaacccatgtcaggatatagtgtttcttaaaataacattctggatttgggacttcctctttgtgcagtgggtgccattctttgaataataaaaaagctaccatctaaaaagtgattttaagtttagcttaatcgtgtaccacatttcctagatatacacggatagaaaacaaacctcctcttgacataatcatctttataatgaatctcatcggaagtcttaatggtaatcttaccatgagaagaagtcaaagcaatgagcaactgaggaaaatgaaaattctggaattagagaaaaaaatgctgataagaaaggacagatgtgatctgagtactgaatcttgttgattttctgaactttatgctcatttgtacatttttattttaagcctggtttccaaaagtctcttgttagcaaccagatggtcgtcaaataattgatacgggttcattttaagcccatttgaggaacataatggcctgaattttccagtagcagggtttagtaattctgctggtctttgaatgccaacagggttttttggaaattgagttccctaatgtcttggaagtaactcttggaaaataggaaccagtgaattgattgcatgatgtacttggaataaaaagttaaggatatggtttattttggctaaaacgtccacccttagaagtggttaaatttgtaaaattaggtgaggatttttgtgtgtgtgtttaagtttttttttatttgttttctgaggcttgagttaatgaatatgaatagacatttcgaatacactaatctgatatttcccattttcagagatccgttcaaactctagggtctgtgcacgtttttacttacatctgggagctaaaaagtctgagctcagaaacagagtagaattatggttataagaggttgggaagggtacagagagaggagggtagggagaggttgattaagggatacagaattacagctagatgggaggaataagttctagtattctgtggcatcataggctgactataaacaacagtttattgtatattttcaaacagctagaagagaggatttcaaatgtttcaagcacgaacaaatgctcagtgtttgaggtgatggatatgctaattctgatttgatcattatacattgtatatatgtattgaaatagcacatgtaccccataaatatgtacaattattatgtgtcaattaaacaaaacactggggtttgctattctaaagtcttactaaatgcttttcaaagaaagaaaaactccttaaagtgtggtttgcaacgagaaaaagggttgtgagctgcctccagagtcagtgagactcaatggtcattttgttattgtttttgagacagggtctcgctctgtcacctaggctggagagtgcagtggcatgatcacaggtcactgcaacctcgacctcttgggctcaagtgattctcccaccccaaccacctgagtagctgcacagtgcctgtgcacgcgccaccacgctggctgatttttgttgttgttttttttctcttggtagacagggtttcgccatgttgcccaggctggtcttgcactctgggctcaagagatcctcccaccttgtcctctcgaagtgctgggattacaggcatgagccaccgcacctgacctgttatttgaactggagaaaggcatcagcaactgttttgggggtgctagtgagccgcaggttgtattgctggaaacagtgaaagagagagctgaggtctgtctgaaaagcctcatgaactgtcagagcggtgacagagcagctgtgctatggagaggtactcctttcaagtgctcttttagttggtattctcagaatgtcactaggtgtttccagcagaatcccatcttgcgaaacgtgtctgtcctgggctctctgttttggtgtgtgcgtacaaagccttcctttcctctcctctgctcacgccaccatggctagccagtctctggctgtcttgggatctgagtggagctcctggtggaaccagacccagaggcctcattggtggacaggttagttttccttggctaccacaacaaatgaccacaaactgggtggcttaaaacaacagaaatttattctctctgatttctggaagccagaagtccagaatcaatgtgccctccaacggtgttctaggggagaagccatttcttgcctctcccagcttctggtggctcctggctttcctttgcttccagccgcatcactcctctctctgccttcctcttcacattgccttctcctctgtccatcttctcctctgtgtgtctcatatgaggacaacacttgtcattggatttagggacccccaggataatccagaatgatctcttcatctcaggatccttaactacatcagcaaggaccctttccccaaataagatcctgattctgggaattagaatgttgacatatctttttagggggttgccattcaatttaccacagtaggagtagcaattcaggatggggccttgaaaaggaagcagaagaaacagaagccttcataatgtgatagtttaaaaaatctgcctggtcatttaaaaaaatccttcagaaagtaactttattgaggcacattttaaatatcatgtaattcacccatttcaagaatatagctcaatggtttttagtaaacatacccagttatgcaaccatcatcataaaatgctttagaacattttcatcaccccaataacatccacatccttcatgcccatttattgttaattcccattcccactcccagcttcactgcctgctgtctgctgtctctctagatctgccttttctggatgtttcatatgagttgtttttttttttttgtgaccgagtcccactctgtcacccagactagagtacagtggtacaatcatggctcactgcagtctcgacctcctgggctcaagtgatcctcccacctcagccttctgagcagctgggaccacaggtgcatgccactatgcttggctaatttgttgttgttgttgtttagacgggtttcactatgttgcctaggctggtctagaactcttgtacttaagcgatcctcccaccttggcctcccaaagtgctgagattgcagacatgagccaccatgcttggcctaaagttttatttaaaacttaagaaaacatttctgattgtaaaatatggagaaggacaatcccatcacctggagcctgttagaaatgcagaatctgcagtttagcaagatccccaaggcattctctatattagacttagacatactggtacattgtatctgctatattgatcccttgtccacttaatatattatgagcacttccccaaaagtattatatctcttctgagaacattttaaatctcattgtaagaatataccacaatctatttaactagccacttcatggcagacattgtttcccatctttttttgcccttgaaaataaagctgcaataattatctttgtatagaaatatttgtgtatagttttatatctactgtatcagtaattccatttctaggaattgattataagacaataattatagacagactgctaaaatttagaaagtgcatatgtaaatactgatcagtggagtcagtcatttaaagtgctgttttccagcatggtactggtaccaaaacagagatatagatcaatggaacagaacagagccctcagaaataacgccgcatgtctacaactatctgatctttgacaaacctgagaaaaacaagcaatggggaaaggattccctatttaataaatggtgctgggaaaactggctagccatatgtggaaagctgaaaccggatcccttccttacaccttatacaaaaatcaattcaagatggattaaagacttaaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacaacaggtgctggagaagatgtggagaaataggaacacttttacactgttggtgggactgtaaactagttcaactattgtggaagtcagtgtggcgattcctcagggatctagaactggaaataccatcccattactgggtatatacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtcaactattgtaagaacaaaaaaccaaacactgcatattctcactcataggtgggaattgaacaatgagatcacatggacacaggaaggggaatatcacactctggggcctgttgtggggtggggggaggggggagggatagcattgggagatatacctaatgctagatgacgagttagtgggtgcagcgcaccagcatggcacatgtatacatatgtaactagcctgcacaatgtgcacatgtaccctaaaacttaaagtataataaaaaaaaaataaagtgctgttttcctggaaactagacctaaagccaagcagataataggaaatgtgaacccccaatacatgatgttagcacatcttgctaactctcacctccttctcctcctccttttttttttttttttgagacagggtcttgctgtctcacccaggctggagtgcagaggtataatcatggctcactgcagccttgacctcctggggtcaagcaatcctcccacctcagcttcccaagtagctgggactacaggtgcacactatcacacctggctaccttaatttcttttctttatagagacagggttttgtcatattgtccagtctggtctcaaactcctgggctcaagtgatctgcccacctcgccctcccaaaaggttgggattacaggtgtgagccactgcacccagccacctccatctgcttgagcattggtttcattgttgaacaaaatgaatgagcaaataatgaatgaatgagtgaatgacaatggcatcaaaaagtgaagtgtaggttgttactgagcagcggtgaaatagaaaggaacaaaatgctggacccacatgtaatcactttcttatctgttgtaattttatccttactcaatttccaacctccactagtcggttctgcccttgtaaagcagcccaatgtgtcactcctggaagcccctgctgcttcaactatctgtagcacactactcctcataggtggaaagtcagtcatgggagtgacgataccttcctcagatcacacctactggcctttcgattccgttttcccacttttcacaaggattgtagtctcttgaatatttactggccttcctagttctcagatccttgggaagtatgtgaagaggtcgggacttgtgtattcacttcgtatctgcccgattgccaggctccttaggtcaaggaggaattgagtgagttccaaggagagggtaagtctgaattttcccctttttttcttttctttttttttttttttttgagatggagtcttgctctgtctcccaggctagagtgcagttgcacaatttcggctcactgtaacctcagcctcctgggttcaagcaattctcctgcctcagcctcccaagtagctgggattacaggcgcccgccatcgtgtccagctaatttttgtatttttagtagagacagggtttcaccatcttggccaggctggtctcgaactcctgacctcgtgatccacccgccttggcctcccaaagtgctgggattacaggtgtgagccaccgcacccggccgaattttcccctttcattttctgcactgctgtgttctctgagctttccactgctatagtgtttcctgatgagaaggaagtgtttcctccagcttttttttcttcctggaggagtaggatatgaaggaatccctgcccccacacggggtgggatccagccagctgctccagaggatctcggcccctcctgtagcctcaaccttttttgtttctctgggtggtgactctcacaccagagcatacgttagaacctcctggagggcttgctcaaacaccgactgctggaccccaccccatgccttctagttcaatagtctgggctggggccagagagtctgcatttctaacaggttctctggtgatgctgctggtgtggaactccactttgagaactactgctctggcccacccctcattgcccctcttcccctgcaattgcttccaagtaggcagaataaggcgctggaggactggtgtgtttgagacccttgcatctagggagcccgtccagacttctaggggtagcgcctagcagtggtgtgtgcctgttccaccaatgaatgcagctttagacaggcccttcagagtataagaagcagtggctcattcaaattccttcaagtagtgggggtgagaactagggggttaaaaacagagccccaggtccttaaggcttcacaggaactcatccagaaagccagcaggtatgggcaggctggggcctcagcctgccacatgcctttgtgtttcagctggcccaaggctgtactgaacattataacctttcagccctggccctttctgttgacttcctctcctctcctcttggtgggattttcccctgtatttagggcagggcagtttcttctggaaggatccctttggctccaggctctgtgtctaaccctcccacttgaccctgtagcacacagccctggccagttgctggtggaagctgcagtccttagtgaaatggggagtggactgtggttcctcaaattgcattgtcatttggaggctcaagggcataccttttttatcctcaaaggcttaaagacaactgatggcagctggagagggttaagggagatggaggaaatcttcattcaagtttgtcttgctcagtgatcttttaatgtgtctttccagtcttggggtggttgtgtggtctttcagtacagattcaggtggcaggcggttggtggtttggtttaaatcagaggtatgttaaaatattcaggatggtgagggtgtctgtgaaaactaagagaggaagtggcttaaagagctaggctgtcagctgggtgcagtggctcacacctgtcatcctggtgctttgggaggctgaggcaggaggatcacttgaggccaggagtttgagaccatcctgggaaacgtagcaagaccttgtctctacaaaaaattaaaaagaaaaaattagctggacatggtggtgtgcgcttgtggtcccagttactcagtaggctgaggtgggaggatcacttgagcccaggagtttgagattacaatgagttatgatcatgccactgaattccagctttggtgacagagtgagaccctgtctctctctaaaaaaaaaaaaaaaaaaaaaaaaaaaaccaggttgtcaagctagatttagaattctttttttaaaaaaaattcttttattttttccatgggattctgcttgatatagacttaattctgttgtctgttggcccagggacatcactgcccagtggatacctcatccactcccactctttttgagggttttctccagggagttgaatctgtgaggcagtctttccctcctgctttcatttctcccccagcatcttctcttaggccctgctaggccacttgagcaagaatctcaggccataaaacatttccacatcagatttcctccaacagcacagggcgcttatggctcacatgtggaagcgtggacattgacatgttattttgagacttctgactttagagcattttgaggaaagtatcttctgaggtctttctttcctgtaagctagctgtagtagccaattccttttgggggatgggggaatgaattcttggcacactctgttgtcctttgggctagtcacatttgtgctaaatatcaggcgagctccctgcggacaccatgggatgaggacaacatcttattcttggcaatttgcaagggacaaattaggctgtggtacttgcaagtagaattattaaatatcaatgggggataataaatgtgaagtagcttgcaaatcttctgatattatggctgtttcagtgaaaacacagctgctaagatactttcctagctgtaatcgagaaggtaattttcctgaaaggccatttaaagcagatctttagtgcctttggctcattaagaagcatgaataggggtaagtctctgaaaaagatgaattagacacagagcagaggagcggtggtgtccatgatgcaggatgatggtgtccagggcctgcgtactccaaatagaccaaggactaattagttgtgtggtttattaatggactggagtcaatcctggactaatacaactaattcttccatttagagttaatgttggcactcaattttccctggtaatgagtgagttagagtaagcaggcacgtgagtgtaagatacagtgctaatattttgtgagaaacattgaacgaggcttgatgtttaaatcaatagttgaaaatgtgggggaagactttccagaaaaggcttacaggctaaataagagcagttaattgaaagcaaaccaagcccacccaatatttagatttgtttagaaaccaagtgaacatttgagatgagaaacatttctctagttctgtgatgtcgtcggctttcctggtgtgtttggagcttttgacattggtgtggtactttacctcagtgaggctgatggaacagagtggatgttacagggcctcaatttcagaattcttgttgtgtactcgtgaagacctgtggagagattttgcctcaagtcagtttggatggtttctgccctccagtctgataaagtcccctgatgtcaaaccacaggtggaatttccagagactgtgatctgtggactggtgacaaatcctttgtgaaaagtctgtgtgacactactaaacagagagggcttgggggaggagaatgaggggaccaatgcgctcccctcagaagccttgatgctctcatagaaggtctggccaggtgtgggggtctagctttgtaaagtaggaagacccctttgatgattactttttttgtctagttaaacctttttggatttctctgtaatttaaagaatataatttttaaaatgtaaagctgaggattcatttttctatgtgttaataaagttaataaaccccccatatttattggggaaggcagtataaactagaatttccttaggtttcttctttctttctttctttctttctttctttctttctttctttctttctttctttctttttttttgagacaggggagtgcagtggcgtgaactcggctcactgtaagctccgcctcctgggttcacgccattctcctgcctcagcctcctgagtagctgggactcctggcgcctgccaccacgcctggctaattttttgtatttttagtagagacggggtttcaccgtgttagccaggatggtctcgatctcctgacctcgtgatccgcccgcctcagcctcccaaagtgctgggattaaaggtgtgagccaccgcgcccggcggcttaggtttcttaaaagttaaccaagtgagcatcactgaagattaaccaaaggatctatgcaaagatgtatttttattttgctcaaacagttgtttataaaaggtaagatgaaaaccaaagcacacattacagagtaggaaatcaagtacttttatttcataccagaaataggaggaaaaggataaaatcagggtgaagccctaaaaaaaagacagtcaaaaaagaccctataggagggctgggagagtttttgagccatgaggaccatttgaccttggtgacagggcagctactgagttcccagaattctgccttttcaagccatgtaacatttgcaaatgctgacaaacagctgctaattccgttttctatgaaagggtgacagggtgttctcaggacatgagcttcttctccccagagccacatgcctttcacacagtgacagtggcaccatcagtgaggacctgggaaggagacaccagtccagaaaaatgatgattcttttttttttttttttttttttttttttttcgagccggagtctcgctctgtcgcccaggctggggtgcagtggtgagatcttggctcactgcaagctccgcctcccgggttcacgccattctcctgcctcagcctcccaagtagctgggactacaggcgcccaccatcacgcctggctaattttttgtatttttagtagagatggggtttcactgtgttagccaggatgatctcagtctcctgaccttgtgatccgcctgtctcagcctcccaaagtgttgggatgacaggcgtgagccgctgcgcctggctgaaaatgatgattcttataggggggtgtgtgtgtgtctgtgtgtgcatgcacgtgtgtgtgtgtgtgtgtgtgtgtgtgtttgtgtgtgtgagagagagagagagacagagactgaattgcttgagaaaatttgcatttgagttcagaagtatgagcccacatctgtgaaagcagtaggtaagagactagtgaatgcagatgactcagatatgcacacaaacctgtggatttacggttttagaaaatacaaatatacattgtgctaaatttgaataatttgaagtgaggtacaattccaaagagcaagttgtgatctaggacaaaggaacctctgggatgagtgacagctcggagagccagaggtggaaggaggaatgaaacacagctactaaggctacctgtgtcatgggccaccctggaggctgggagatctcttcttatgggtttctctcctatttgtgtctgtgtgcctatctgtattctctatgtgagtctctatgcttgtgcatcagtgtctctgtgtatgggggttctgtttttctgtgtctatgggtctgcctctcccactcgctgtaaacgggctaccccagaaacacttgccagatggagcacactggcctgggtcaatgccacatatggtttcttacaagttgcagaaaggttacacttagcaaaaatgggtgtgccccaaagccccacacagtgaacaggttttctcatgatcttgtcacacctgtcacaagagtgggggaagatgaggaggaagagccagctggaagttttagaatcgtgtttaatttgtggtttacatcctcctcccgacccttttccctgacaaaccacccacacacttttcactttgcattacatttgtcctcgcccatctccatgggatattcctagaattctgaatgcttcctttgactttctctactgcagaaactcttctccctgggaatgatttttacagctccagttaattttcatgttcaatgttggaacggagaggaaatggggggagcatgggtggtgactcaggaagctgaggaaatcgcccttattaggcctcgaattttcttctaaaaaaaaacaaaaaacaaaaactggccccaggctgtttgggccttatttttttctgattgctagctttcatttgacctccctccttccatttctttctctctttggttctgctttgaaggtcacaaagcttcccaaagctgttaaaggtggtgctaactccctttactgaaagattactcttcagctgtaccagtggatttcccctaacagcgctcccagaagatgaacagactctcttattgttggtaataactgagtttttaaagaggacaccatcattggcaataatttaaatgacttttctaaggtattttcccaactgtttttctctttttcctcttccacttgagcaaatgtcatgaatttccttttttttaaaccaccaacacaagtattttttttcttaaataatgtgtatacttaaaatttgtaaaatgcaggcaggaaccagaaagataattcattttctagccagtcgtttgttgtaagcctgatatgtgtttgttatttttctacaaaaatggaatcatatggtaggtggtgttttataagaagtttttttttttgttttaattgtggtgaaatacacaacagaaaattgtaaccaattttttttttttttttttgagacggagtttcgcttttgtcgcccaggcaggagtgccatggcagaatctcagctcactgcaacctttgcctcctgggttcaagcaattctcctgcctcagcctcctgagtagctgggattactggtgcgcaccaccatgcctggctaatttctgtagttttagtagagatgggatttcaccatgttggccaggctgatcttgaactcctggcctcaggcgatctgcccgctttggccccccaaagtgctggaattacaggcatgagccaccgtgcccagctgtaaccaatttttaagtgtaatactaagttacttaattttctacaacatcagtaatgtttttcaagttttttaaagttgcagaaccctttcctcaaagaccagagagcttcaagcagagctgcaccaccattgaggcaggagtggggagcccaggctatatcttgtcaatgttgcagtttacggttaccctccccatagctttgaggcctcctagggatcctggtcacactcagtagccaactttgaaagcacatagacctaccttatactgccccaattgttaatagcttagattgctctaattttcttataaagaaaaaattttggacatactttaaatcctctttgaagcacatctgtgattacttccctagataagtccttataagtagagttactgggtttagaatatgagcggtgttgttgtttttttctttttggcctataatccatattgccaactggtcttcaccaaagtgtgccacatcagactctcacagtaatgtaggagaaggctcaaccccccattccctgggtaaaataaaccttaaaaattcagtatgttagcaaaagaaattatcaacagggtaaacagacaacctacagaatgagagaaaatatttgcaaactattcacctgacaaaggtctaatattcagcacgtgtaaggaacttaaatttacaagaaaagccattaaaaagtgggcaaaggacatgaacagacactttttaaaagaagacctgcatgtgaccaacaagaatatgaaaaaaagctcaatatcgttgatcattagggaaatgcatatcaaaaccacagtgaggtaccatctcacaccagtcagaatggctattattaaaaagtaaaaaaaaaaaaaataacatgctggtaaggttacagagaaaagggaacacttatacactcttggtgggaatgtaaattagttcaaccactgtggaaagcagtgtggcaattcctcaaagagctaaaaacagaactaccattcgacccagcagtcccattactgggtatatacccgaaggaatataagtcattctaccataaagacacacgcacaagtatgttcattgccacactcttcacaatagcaaaaacatgaaatcagcctaaatgcccattagtgatagattggataaagaaaatatggtatatatacaccatggaatactatgcagccataaaaaagaatgagatcatgtcttttgtgggaacacggatggagctggaggccattatccttagcagactaacacaggaacagaaaaccaaataccgcatgttctcacttataagtgggagctaaaggatgagaacacatggacacaagggaacagacatgggggcctacttaagggtagagggtggaaggagggagaagagcagaaaaaataactattgagtactaggcttggtacctggatgacgaaataatctgtacaacaaaccctcatgacactagtttacctatataacaaacctgcacttagtgacattattttcgtatgtctgttggccatatatggttcttctttgaactatttattcataacctttgcccatttttagattcagatgtttgtccatgaatccgagagtgagaacccttggttatactgtgtgtagacattttaagcgatattttcaagaatcagctgtgacacaaaaggagtgggggattgtgggccaaaagtcttacagtcagagtttagcatgagaacttggaaagaataaacttctggactttgatctctgattttatgattctgtgatactagatgacttatctgccatttaggaaggttctgtcatattgactagagagaaaatccggagttaaaaccaatggctgcattaagttagattttttttagcagtctgattaatctttactgctccagtactcaaactgcaacgtgagagttcaatcttgtggcttattacaaccacacattgtattaaacatcttctacttgagaaaaacatgaagtgccccatgtgcattttgagtatgttatatcatgagtaaagtcatggctggaaggtagttaagacagaatttctttttgtttgtttggcaagtgatgctaaatcaacaataatattgctttgaaaaggagcaaaattatgccatgactatttgcaatgaaaataaattataaggcctggtgtggtggctcacacctgtaatcccagcactttgggaggccaaactgggtggattgcttgagtccaggagttcaagaccagcctgggcaacttggcgagaccctgtctctacgaaaaaaaaagaaaaagaagaaaaagacaaaaattagccgggcatggtggtgcatgcctgtagtcccagctactcagaaggctgagatgggaggactgcttgagcctgggaggtggaggttgcagtgagctgagatcgagccactgctctgtactctagcctgagtgacagagctagaccctgtctcaaaaaaaaaaaaaaaaaaaaaattataacgcagctgtataataatattgctcaatatgctattataaagtgaaaacctccttctgcttaacaggaggtgtctctatttcaggacaggacactttacatggaataagaacaaagatcttactaatttaaaaaaaaaaacccaaatgtgtgtgtgtgtgtacactgaatttggccagacaggaaaacaagattaaaatgtcagttctgtcttttcaacctgaatgcctccaacagctacattttagaaatttctgaaataattaatgtgtactcatatgttcacccataaatcagaccatgggattactgatgaaaggatgcaaacttgggggtcagtcttggaaaattttgactgaattttaatcttcctattgtgaacatctatttcatgttgaaaactcagcatttcctgtttctcctaaacatagacaccacaataaatagtttgtatctatttcttttccttcaaaaagatcacagttctttgcctgtattatctagctccaagataaattaaatgccagctgaaattgtttggtgtatctaggatgcccatggtatgtgccatttggttgtgtggctgagtcagtggcgttaggtggagtttagcctccccctgagtggttattagggttgtggatggaatgtattgaattcaaatctctcatttataaggcgaggtgtgaattgtagaatgatccgattaacttgggctgaaccccagatattgctgtgtgctttttttcccccttcaacatgtcatggaggcttaaaacagtcacccacacgccctttccatatttaaccttttggaggtgctgtcttattgctgagccagggtggtaatagctgactggcttaaatggacagacagcaacaagatagctgaggagggtaatagatcctgccattctgttcatctgcgtttgtgtctgggtaaaattctcattaagttgcagccagtgtgtgtattttgtgtgtctgtgcattgtgtttgcagtccattagaaaactgatacccatgtggtgccttggtattgacaggtttcctgtgtgtgacctaaaaccattctgcattttcatttgtcaggttttcccgtgtgctctgggttcagagcaaattaacttccaagtcaacagaaccaccgaagttctgcttgaactaaagctaagctactctactggtgtggggggagggaggatgttgatcattagaggacaagggcaagttgagaaattgttctatatttcagccagttaattatcgcagcttcccagcatgtctgcaaggagaaatgagaagaacatcaataagtgattattttctttcattattctgttcacctgccatttactgtgcacgttccaggggaagggagattagcaggggttaactttaaaaaatcagagtcccagaggactcacaaaggcatgctgtgtctgcctttctggtactgagtgatgagggtgggacagggctggtgctaaacttttggatctatttttaagctttcaggacaaattttataaatacgagctgcttctttaaaaaaaaatccctttctactctaaaaatagtttgctgggaaaaagtttgtgaattgtttattaagactcagaaattcagctgagcatgtttccttataaataaagaaaatcacctcacagctactgtcaaaaagcagatgtggcttcttaggaaagaaacaagatttctgggatgttaatgccaatgtcagaatgtgggagaaaatttggaattttccctcctggcttgctcttttcagaccttctaaattctactcatttcttatgatcaagttggtgtcttgtcccttttggaaagagttttcccaggcagaatgaatggccttagcttctgttcttaccagtacccttagccacacctgtctcttttcctataacactttgttttatgttaatgacaattgctaatatttactgtatgccaggcactgttctaagctcagttcatgtgctattttattttgttgtcataactctttgaattagatactactattctcattttaaggataaggactatggtaggcagaataatggcccctcaaaggtgtccacgttctaatcttcagaacctgtgagtgtttaccttacgatgcagatatggttaaggattttggattagaatcacaagggtccttataagagggaagcacatgggcaacaaaagcaaaaatacataaattagacaacatcaaaatgtaaaacttccgtacatcaaaagatacaatcggaccaggcgtggtggctcatgcctgtaatcccagcactttgggaggccgaggcgggtggatcacgaggtaaggaggtcgagaccatggtgaaaccccatctctactaaaaatacaaaaaattagccaggcctggtggcgggcacctgtagtcccagctactcgggaggctgaggcaggagaatggtgtaaactgggaggcggagcttgcggtgagccgagattgtgccactgcactccagcctgggcgacggagcaagactctgtctcaaaaaaaaaaaaaaaaaaaaaaaaaaaaaaaaaaaaaaagatgcaatcaacagactcaaagtgcaatctgaacaatggagaaaatattttcaaatcatatatctgataaggggttaatatccagaatctataaagaactcctacaactcaacaacaaaacaaataacccaattcaaaatgggcaagggacttgaatagacagttttccaaagaagacataccaatgaccaacaagcagatgaaaagatgctcaacatcactgaccatcagggaaatgcaaatcaaaatcacagtgagattgcacctcatacccattaggatggctgctataaaaaaagaaaaaacaacaagtgttggtgaggatgtggaacaattgaaacctttatatactgtcggtggggatgtaaaatggtgtagctaccataaaaaacaatgtggcagttccttgaacaattaaaaatagaattaccatatgatctagcaattttacttctgggtatatatccaaaagaattgaaagcagggtctcagagatattatacacccatgtgcacagtagtattcacagaaggcaaaaggtggaagcaacccaagtgtctatacaacagaatatcattctgcctcaaaagaaggaaattctgacacatgctacaatgcggttgaaccttgatacattatgctaagtgacagaagccagtcacaaaaggacaaatactgtatgacttaacctatatgaggtatctaaagtcaactttacagagacagaaaatggactgctggttgccaggagctggtgggaggggagaaaggagttgtttaatgggtacagagcttctttttcagttttgcaagaggaaaagaaatctgatgatcttttgcacaatgtgactgtacttaacactactgaactgtgtagtttaaacctgttaagatgttaaattttatgtaacgtgtatttaccacaattaaaaaaaattttttttaaaaagggaggcagtaagatcagagttagtgatgatagaagcagaggtcagagagagagcgagcattgaagatgctatactgctggcctcgaagatggaggaagggaatacaagctaaggaatgcaggtaacccctagaggctggaaagggtgggagaacctcctctcctacagcccctgaatgaatgcagcctgccaacacctccattttagcccagtaagacagtttctggatttctaacctccagaactgtgagatactaactttgggttaagtcgccaagtttttggtaatctgttagagcagtggtaagaaactattactaaggactattcagttcagagaggttaggaccttgtgcatggtcacgaagtgactggaactctgattaagagctggagctggccaggcaggatggctcacacctgtaatcccagcactttggaaggccaaggtgggcggatcacttgaggtcaggagttggagaccagcctggccaacatggtgaaaccccgtctctacttaaaaaaaaaaaaaaaaaaaaaaaaaaaagaactgcaaaaattagctgggcatggtggcacagcctgtagttccagctattcaggaggctgaggcagaagaatcgcttgaacccgggaggcagaggttgctgtgagccaagatcgcaccactgcactccagcctggcaacagagcaagactcagtctaaaaaaaaaaaaaagagttggagcgcatgtccactccactcagagttccagccttcctagatggtgagaccctaggtagcagtggccatctttaacactacccccgacataggacttgatatatattaaggcacttagtaattgtggctaaaagatttaatgataatgcaccatcgccttttattctgttcccctgatgctgtgtcctagaagccatagggttaaacctaggaaaaggctttttagaaaacgtttcccttccctgtcattgtggggctgctaaggaatagtgtcctcaaggttttagtgtcacttctgggggcctctgggtatttgttgccaggtcccatgatggagtagagtcaggagtgcttatagaatccagacaggggtcagagtcaggggaaatttggatcctgttcttggtagatgggcagtctgttttgagaagaaatgaccaaatttagtcatgacctgttaacctgtttattaacattatttctctttaagctaaataaacgcagatatttctaagcacaaatgaagaaatttctgtgttagctctgatcagtgggcatttcccactctgaaatgcttcctcacccccaaacctaagctttggaaaccaggctcctaaaatcagggccttgtaattccccatgtgagttattctaaattgggcttctgggtgtttctttttttgaagtggggagcaggtgggaaatgagaggccttctaataatgtgcattaacttttgccataaaattattagaaaaaatgggtattttgtactttttttttttttttttttttgagacagagtcttgctctgtcacccaggctggaatgcagtgggcaattgtagttcactgcaacctccacctcctgggctcaggtggtcctcctgcctcctgagtagctaggactacaggtgcatgccactgtgtccagctagtttttgtgttttttgtgtagacggggtttcaccatgttacccaggctggtctcgaactccgtacctcaagagatctgcccaccttggcctcccaaagtgctgggattacaggcatgagccaccgtgcccggcctactttgtacttttaaaataatctttgagtgggaaggcctttgcaatcatgtcacaaatctgaaagacctaagggaaaagattgattgattttactacatagaaattagagacttctgtatggacagagatagaattaatagaataaacagacaaatgacaaacaggtaaattctgcaacacatatgacagccccaggggcacttcttttatatacagagagctattagaaatgagagggaaaagcaggatgctatgtaggagaattgacaaaagacatgagtaagctcatcacagaaaaagacaagtggataacggtaagcatatggaaagctgttcaaccttattttttactaattaaagaaatgcaaattaaatatcatctcctgttatcagattggcaaaaatgaagacatttaaaaatagtatggggaaatcagctctcttccatgctattggtgggagtgtaattgataaattttttggaggccagttttttattatctgctaaaagtaaggatgcaccaagttgttgacccagaaatttcactctagggaatttgtccctcagttgcctttgtggtatatgtgcagagttatgggcacagtgatgctcaatgtagtgttgtttgtaatcgcagaggacttgagacaactgggtggtttcatgtgggttatagttctgtgagaagagaactatctcctacccagcaagattcaaataagttacccgtttaaccagccaaggatacagaaatttagaaaggagattgcctcaggcaggagcgtatgaggtatatataaaaggtatatcccagataccaatctccactcgcaggtttccagtggtctaaatggcaagggagattttgccagatctcagaaacagccaaagtttgctgtgccacaaatcttttttccatgagcatttcagaagagccaatgaggacaactgttgtgccttcatctgtggtatggtgacaaataacgcagctcacctgattcaccttgcctgctgcctagacagagccgatttatcaagacaggggaattgcagtggagaaagagtaattcctgcagagctggctgtgtgggagaccagagttttattattactcaaggaattggaatttttaaagataatttggcaggtagggcttgggaagtgggtagtgctgattcaggtcaggttggagatggaatcatagtgggggtcaaagttaggtttccttgctatcttatgttcctgggtgggatcgcacaactggttgagccagtttaccagtctggatggtgtcagctgatctagtagagggtctgcaaaatacctcaagcactgatcttaggttttacagtagtgatgttatccccaggagcaatttggggaggttcagactcttgccaggagctgcatgacccctaaactgtaatttctaatcttgcagctaatttcttagccctccaaaggcatactggtccccaggcaagaagagggtcttttctggaaagggctattatcaattttgttttacagtcaaaccgtaaactaaattcttttccaaggttagttcggcctacgcccaggaacgaacagggacagcttaaaggttagaagcaagatggagtcggttaggtctgatctctttcattgtcataatttcctcagttttaattttcgcaaaggcagtttcacttccgtgttccaaaatctactttcagacacaaccagactgtcccttttgatactggtctatcctacagttggattctgtgcagctatgaggaagaggggcaaagctctgatggagaagttgtctaagatgcattgttaagttgaagaaagcaagttgcagtatagcacacatagtaagagtccatttgtgtcctcttgttatgtattttttggaatgaacatgtatacctttaattattaatttttgagtggttacccacacacagttttgaaagtcatatgctgctaaaagatgtgtgagtacccagcagcctcttgtcccttctctttgtgtccttatattctaggaggcagtcgttcttcagttctagctgttgcttctactatttgctgctgtgcttctgaataatattcattgctgctctcttggtttgtcgattctagatatgatctcttaactatcatggtagttgaggacttcagcttttctctatatgcacatatctcaggttttgctttaatctatacttaatgttttcattaatgtagcaatgttgatattgaatattgaagcaagaatatactataattaacttacgtatatagctttatttctctctctccctcctttcctccctctctccccatctccctctctccctctctctcccccctccctccccactctctcccttctctctctatccctctctctctctgtccttccttcctcttcgtccctccctctctctctttctctctcccctacttcctctcttctctctctctctccctccctctctcaccaccatctccctctccctccctctctctcttccccccctccctcctccttgttttcttctcccccctcccctcccccctctctacctctctccttctccctctcctggaaaaacaccagagccttccaacctcctgttccactctgctgcccagctgtcagccaggaaattcccatcacacctccgccgcctcctctctctcattgactgtcctggatcttgcgtccttctctttcttgttttactcatttgacttgatggaatgcaccctccagtagccttctgagggagccagtgcacggcttcaagtaaattttttgaaacttcttcaaaaccaaccacactaggagttgcatactaaaaagtttttccttttagcattcaaccatcccttcttagcccctggcccatgtctgttggcaggtggggttctccctcctactgatggagccagagaatcctgggacccagaggctgtgccattattcacaagatcttatttaatcttcagaatggtttgataaactaacaaaactgaggcaccaaggttacgctctcagtggtatcagaaccaggaattgaagtgtcagctgcttgggccaggctgatgcctttcctaatctagctgctccttactggaagaaggaataacagtaccatgccccaagtgacacatgccagatgcatgtaaccatggttacagggtgagtccaattctcggtgcccacttgtgtctggttcctgacaacttcagctctagatagccatccttctctctagaagtaccttccagtatgtatgtatgtatgtatgtatgtatgtatgtatgtatgtatgtatgtatttatttattttgagacagaatctcactctgttgcccaggctggagtgcagtggtgcgatctcagctcactgcaagctctgtctcccgtgttcatgccattcttctgcctcagcctcccgagtagctggaactacaggcgcctgccaccgcgcctggcttattttttgtatttttagtagagacaaggtttcactgtgttagccaggatagtctcaatctcctgaccttgtgatccacctgcctcggcctcccaaagtgctgggattacagatgtgagccaccgcgcccagccaagtgtgtgtgtgtgtgtgtcgagagagagagagagagagagagagagagagagagagagagagggagagagagagagagaggagagagagagagaccgagactgatttatagttatggtcctagctccttatggtaattaaaatgccctgcctatgatttgtgtaaacttggtgtgattatttttattgctacagtatttggttttaagcaatgtaagaatgtcacccccctcctcccattccttttgtgatgtgaaatgcttcattacttaggaatttgctgctgattgtacagtttagcatttgatctttttgttaaccacagtcaggtgaccacacatagggtaattagattaacccacccctcctcttctccactgaaacaatgtaaaatccaatattctattagcacatgccttccgtagattaatgatcttggagttgctgcgtggaaatttgcatagctccctacagctctaagaaatgaaaatgcccagctgtctaaaagctttaatcaggaaatgagcatgaaatggcattgttttgtcacgggcttggaataatttattcttgacaatcgagttatcctggatataaatgtgtataaacattctttcaacaaccagtaaacaggtgcttttttgttcgttaaaaagtcaagattttcttgacttgggcttggctttgaaatcgttggccctcgtgctggtcactgccaaaagtttatactaaagtcattttccttgtccctcctgttttaaatggcagtttctggaggctggcctttcagagcaagaacggtcttagggagtgaaggaatggggacatggccataggaccacacggggtcattcctcacccagccccttcttgcctgtgttttcatcccctcttgggacctactttcccctatctgtcaaatacaaataataatggcccctatctcttaatgtggttgtgagcattaaatgtgttatcccatgtaaagccttagaaaagtaccttgttcatggtatattcttcataatggcgagctaattccataagacatagggaaatgaagatgcaattctgtttctttttctatttaaaatatcctagtgcacttaaatttttttctgttagactattagtcttggaagcaattgtgactataaatgctttcatttatgttggcacaccgttaaaagaatgatagaactaatgataatggctaacattcattgaatgcctgggagtgaaagactgaatgaggcctattcctgactcttggggctagacataaggacccatgcttatagcccaggggtgtgtgacaggctcttactcatcatcaaagctgttaaaaagacagcagaaacggcccttggaccttggatgttgcttcctctttttttctcctccaagagcaagctttttatctagcacgtgatttaacagttcctgtgttgggggtactgtttcatggactaggtatgatgtagtgagaaacattttaaaatttttccagaggagactttgatgggaaaaatgcccatccctcaggggactcaatttgagatcgtgtaattaaccttttggagcataattagccaaactgtttagctctttttacttgtactctgggcaccaaagaaagctggatcctacccatgataaaactatcatcaataagatttaatgttgcctctttatatgcattttatttttcttgattgtcatgcccttagttattcttgcatttcaagaatctttttttttttttttttttttttttgaaacgaagtctcactctgtggcccaggccggagttcagtggtgcgatatcagttcactgcaacctccgcttccagggttcaagcgattctcctgcctcagcctcccgagtagctgggattacaggcacgtgccaccacacctggctactttttttgtatttttagtagaggcggagtttcaccatgttggccaggctggtctcgaactcctgccctcaggtgatccgcccaccttggcctctcagagtgctgggattacaggtgtgagccactgcccccggccttgaatcttgaactttatatcacatgactgaaaaaaaaacattgattattgggttttgcctgattttccccacatcttagctttcctgtctcccctgcttaatgaaacgtatggactggagagctttctgtaaatcttttgtgtatgttagcatacactgttggatctttaaaatcagtagtggaaattatatagctaaactcttattggggggcagtgtcaacttcttccttgtgtcaatcaagaaaaatgatgagacaagtctcaatcattttaggaagtttatttgccaaagttaaggacgcacgcccgggagacaggtgctatgcctttctctgaagatgattttgagggctccaaatttaaaggcgaaagggtgggatattgagaagtatacaattttcacataagaggcgggtagggaaaaatagttattcatgtctttgtctggctcggtgaatctgcttttttttttttttttgacataagataatatagacaaatggggcagaggaaaaatgcagggaatctgtgtttttacataagataacatagacaaaatggggcaggagaacagtcagatatgcatttgtgtctggtgagcaggggacaactgcacctgtaaagataagctatcaatttacattgccatggtgaaatcttaagagaaacaccttagggtaaagaccttggagctcactaggaatttccttgtgggtaaaatatggggtaggcatgtagtttttcatcttgtagccattgtattcaggaaccaaaaggggaggcaggtttgcgtgacccagttcccagcttgactttttcctttagcttagtgattttgggaccccaggatttattttccgttcacacttgtttgcaaaaaaaaaaaaaaaaaaaagcagtcaataatttaacgatcaggaaatagtaaacatatttcaattactcaatgtttaagttaattaaaattttgaatagctaacacaggcatatggtgccagctaaaagggacaaaatatatgctttctctgtccctcggccacctggttcccctccctggaggcagcctcagttatcagtttattgtgtgtggcttctgtattacacacagaggcgtacatacaaatgtacacaaatgctagcatacgttaggctttttttttttttttttaacctagcaacatgtcttggtgattgtctttcttggtacatacagactgacttcagtcttggagagagttgcatgggattgatttatggccattcatcagctgctctctactgatacacatttatgttctttcagtcttttgctaatttaagcaatggcataacgattaatcttgtacatatgctgttttgcacgtgtatatttgtagtttaaattcctaggagtagaaatactgagtcaaaaggcacagacatttaaatttttgatagacagttgtcaagttgcttcccacagaggctgtacaaatttatttatcaatttatactctacttagaaagtatgtgaggctctctttccctacacccttgctgacattatcaatttttttaattgttgacaatctgacagataaaaatatctcattgtaatttaaaaattaggtacatccctccctaaactgtcaaattctggagagatttgttcttggggtcctcatagcccccattctttgagaggaccagctgtgtgccaggcactacgtcacatgctgtgaaaacaaacagtattctgagagagccagattctagtgcgaggacacatgtaaacattattataatatagtatgtaatatatactatagtataatatagtatgtaaatgctacaattctaggtatgagaaaatagccggaatgatacagggtccttctgtgtactgagcactgtcaggcactgttgtacaggaataccactgtaattttcatttctcttgttgtaccaggacaagccgcagacaaaactcctcagacaccgagttaaagaaggaagtggtttattcggccaggagcatcggcaagactcctgtctcaagagccgagctccctgagtgagcaatttctgtcccttttaagggctcacaactctaagggggtctgcgtgagagggtcatgatcgatttgagcaagcagggggtacgtgactggggactgcatgcagcggtaatcagaacgaaacagaacaggacagggatttttacaatgcctttttatacaatgtctggaatctatagataacataaccggttaggtcaggggttgatctttaactaccaggcttaggtcaggcaggcccaggcctagtttcaggtctggttcctaggcgccaggctacctgcctttagtttcgcttctctttctttttctgagtataaaacagtataaaacaatatgagacgttctgtctctcttctctcatcgtgaatgcagttaagcatcttgttgcatgtttgagtcatttttttcttttttatgtgacctgtcctttgctatttttttgttgggttattgatcttttgctgatactttgtagaaggagctctctttatagaagaggcaacattcccccagtttgtcttttgtcttcgttgatgaattttgtcgttgttgttgtttgctatgttatattcttagttttctgtaatttatttttatttatttatttattttgagacagagtctcgccctgtcgcccaggctggagtccgatggcgcaatcttggctcattgcaacctccgcctcctgggttcaagcgatgctcctgcctctgcctcctaagtagctgggattacaggcacacgccaccacaccctgataattttttgtatctttagtagaggcagggtttcaccatgttggccaggctggtctcaaactcctgacctcgtgatccgcctgcctggcctcccaaagtgctgggattacagacgtgagccaccgtgcctgccattctgtaatttattgaccctttcttttctagcttctaaattctgtgtcagagtgttaaattatctttgcctttctgagattgtagaaacattctttattttcttctagtgctttaaaggtttagtttttaaatgagtaaattcattttgaatgtctaatattcccagttaaataaagaaataagtattacttgtttttttaaaaaagttagggactacatgaattttcttactgtatcatcttctcccctctgctcctaagcctgatctgcatcttttaaggtgagaagttgatggtgatccagccgtatctttatagggatgatacagatctccatgttgttgcagctttgggctcaattgagaatattctgcctctgatcacttgaggtcaggaattcgagaccagcctggtcaacatggtgaaactgggtctttactaaaaatacaaaaattagctggatgttggtggtgggtgcctgtaatcccagctactaggcagactgagacaggagaatcgcttgaacccaagaggcagaggttatgacagagcaagactcctccctacgccccaccaaaagaaagaaaatactctacttcatctgtagacagccatcttgcccataacactctactaaattggtcattcatctgatagatatttttaagtatccaaacaactggttgatattgacaccctttgatccagtggtaataatctagatgtttagcggggtgtgggcaaacataaaggcaccaactgtcatgcaagtaattacactgtacatcgggaagcaacattatctctttgggacacaaaggtagtcgttctcatttttgtccagtatctgttacttgttgtggtctttatagtgttcatccctttcctgaaggtcaagagcttcttgcccttgttctcatgttcttgttattttcttattcgtgttatgagtgattcttgggagataatactgcaagtatatgatattgcaaatatgcagttaaagattgacatagaacatggtaatagacctgttacatttcttgaaatttccttgttagctttgagctgaaaataccatcagaatatttatgagtatatatcaaagcacttttctgagcatcagcatattttgtaagtatgagaaagccattgtggtgtgagacatcaacgtggttctgctatgtaattttagggcaaattatgaaatatgtaaagcatataacaaatacctatgtgcccatcacccttgctttattaaatcctcatattttgccatatttactttatgttttttttcttctttacagttctaatgaagttggtgcacttggtggtttgatagcatgggtattttcttttattgtggtaatcagatatattttttaaagaaacagaatcttaaagctacagctgaagctccccttggtagtctgccatattctcagaatacttgctgtgtcttcccaggtgttctgagacagaccagccttttgtgaagagagccaaatactgggaaggcacagtctctgcacgaagggaacatactcacggggcagctgttcctcagacttgccttttgcgtggggtggggtggggtcaggggagagatatgcatgttggggaacaatgtgctattctaggtttctgtgtctattcaaagctgtcttgatcagtagacttggtaaaagtgtttgtttttagtgatttttaaaaatctcctgccagtggtaattttgcaaaatggttttctatgaactagtgcagggggcacagctgtgatcctgcagccacgtctgggtctaaaggaagcctttcctgcagaaagcaatagagcaggactgagggcaggctgatgaatgatgtctgtttcccctgccctgcttccaccctaagccaagggggctctgcccaacctcactcagctcttcaaatgcagagagaagtaccaggaccagcattctgggcagatcagggtggtgcccagctttccctggtgtccgtggcaccagcctgctctgtgtgccaatactgttggtgacaggagagagagaaatctggcaagatagggggaaaacagctgaggtggagaacaaggatgccctcttgggaacagatccattcatctgattgggtaggtgagatgagacacgcatggctcacctactccatagggtgcatctggcacattccgaccacctgccccattgatgttgatcccagaaaacatctcaccacctgagatgaacattaaaatacccaagcactagctttgtgtatgtctgacctcctaggagaaaatatcagcacatttcaatttaaaagaatctgtcttctttcagtttaagcatttgtgctgttcttttaaattgaaattgcatgcagtgaagtgcagaggtcttagaagtacagttcaatgaatattttggtctatgtacacctgtgtaaccaccacccagacctcgttataggacattttcatcctcccaggagactccctggtacacctccccaagtgtaactgctgttctgagatctctcaccaatgattaattttgcctgttgttgggtttcacataattggaatcatacagtacatcatcttttatgtctggcttctgtcattcaacattatgactgtgaatttcatctgtgttatgtatagttctttttaaaatagtatttgctatttaataatgagagtagataatcaatttgtatactactctctaattcactctttgatcctgaagacacctctcggatggtgtgtttgttgttagacctcttttacagatgacagaagggctgcatagagactttaagtgttgcccccaaggtcacacctcagataaatgatgacgtcagtactagttctggttttctgatgcacagcatcattctccattcatcgtgaagcctgtgccttaaactgtgttatgaatggtgaaagaagtaaaggatgaaaggagggaggggcccccaaactgatcatattttggtattttactgtgtagtattttggttacagactgaccagttaatttaaaggagttaacactgaacccagccaactcaccagtacctgtaaagtatgaaacggatggtgagggagaagagaaaagaggtagccaacttggctcagcagccagccagatccaggcaacgcagcttatcagaaagcagaccatcctagcatagctcgcagttgcatgcacatcatctgtttgcccggtgaggctgctgtttgcaggccgctgaatgtgtcgtgaatttttgccagagtggcattattctggctttttggtctctgaatgtgggtgagccatcccaggctctgtttggtacagtgcttttgggaagggaatggtgtgagttctcttccttttctcaagtggtccttgtgacacagctgaagcgtcctttgcagcattgataccttattgatggcctcggttttattgtacatgctgagtttccattgtaaagagatcagatctgagataaagagaagctgggtttcctttgctttctgaagaggtttgctgataccctgtctgttctatattgtctttaagcaagcaaaatcattgctgatttatatatgtgggcagttatgtatgcatttccatgagccctcatggcctgtaattctggtccagggtgtggcctctactactgagattataggacccaggttcttaacaaatggcaaaaaaacacgggcctgatggtcagaaagttgcaattaaagacgggggtctaggaacccccagtcccaggaaatccagagtcccatgacctggatcagaacctcggagagctccaggtacttggctgttggcagatatacagaggcaggagttgctctagttccaagccaaccctcctctgcaggaaggagctcttctatgtggatggataataagggacttcaaagatttgggcctcaatagtcttgggctttataggtaaggtgatctgttacatcacttaactgtggagggaagctaaggtttccactggagccacaggctgagtggttttgagtctccctcctatagtcatgccactggttcttcttaggaggtgagatgtactaggagagctctgcctagaaggctcagagtttggtttcatggccagctctgccccttgctagctttgtggccttcatctgatcttgcatcttctctgactgggtctcactattcttatgtataaaaatatatgtttggcaaaatcagttgtttttttttttcctgacagtgttgttgttaggaacaagtgaaaaaatagctgctaaagcactttaatttataagcctttgccagtgtacagttgtatcattgctagcatcatcacctatttttagagcctgtggataggaatccatgacgtcaggattctgtgaacataaggtgttgtccaagcagtgcaccatcccccaacttatatttgcatggtaattggttctgtggggtcagcatgcatgtcacatatttttagtcagaagcaagtacacagagacttgtggtttgctgttcaatttgaaaagtgtttgaatgaaagcttgtcctgtggtcttttggaagtaactggagatttctgtagggactgacaagaacaacagacgtttgagtgtccattttgcagaggctaaactgggaggggagagattgtaggcaggaagacatgattataatccaggcagtactccaggaaacagtggttaagagatgagctctcgcctgtaatcccagcattttgggaggccaaggtgggcggattacttgaggtcaggagcttgagaccagtctggccaacatggcgaaactctgcctctactaaaaaacacaaaaattagccgggtgaggtggcacgtgcctgtaatcccagctattcgggaggctgagacatgaccattgcctgaacccggaagtggaggttgcagtgaactgagatcacgccattgtactccagcctgggcaacagagtgagactgtctcaaaagaaaaaaaaaatgagagagatgagctctgaagctagacaggttgagttccaatcctggctcctacttgtctgaccttgagcaagtttgcttagccccctgggtcttgtgtgggtgtctgagtagggccatagtgtagattaaaagttgcagtccaggtgaagctcttagagcggggtttggcacatggtaagcactcagatgttagctgctattcatgtgggagtcttctattcattttattgtggtaatatatgtaacataaaatttaccattttagttattttaagtgtacagtcagtagcattaattacattagaatgttgtgcaactatccgtactatctatgtccaaaacattttcactactcctgagagaaccctttaactatcaaacagtaacttcccattctgcctctcccaacctttcaggtaacctctaatctactttctatctctatgaatttgcctattctagatatttcacataggtggactcatacaatgtttatccctttgtgtgttttatttcacttagcataatgttttccaggttcatccatgttgtagcatgtatcagaactttattccttttcgaggctgtataatattccattttgtggatataccatatcttgtttatccattcatctcttaatggacacttgggttatttccttcttttggctattatgtataaagttgcagtaaacactggcatacaagtttgccttgggggcaaagctttcaattctgctggggtccctgctttcaatgcttttgagtatatacctagaagtggaattgctggatcagatggtaattctatatttaactttctaaggagctgccatactgttttccacaggagctgccctattttacattcccattagcaatatacaaagattccagtttctccacatcctcatcaacacttgttttcttttaaaattctagccatcctagtaggtacgaaagggtatttcattgtggttttcatttgcatttccctaatgactaatgatgttgaacatcgtgtcacatgctcattagccacttgtatgttttctttggagaaacgtctattcaagtcctttgcttggcatttatatttttttccctttatgtttttaagatactacaggaggacaaaaaagaaacagattgagaaagtagatgcagccagactgggcgactgcttagatagggggataatactgaattttctactctgggtaattgggtggatgatggggtaccaaagaagacaggctgccctttcctgggagaaggggcaggttggagaaaaggtattggctttgggtggggctgcattgagcttgggtgttatccaggtggggagcctatagaattaactgccacggccatgtgtccgattggtttctctgaaaaaaatgcaagacatattttaggttttgtctcctccctgcttccacctaaagaagcaacttaagcaattcactcatcattcagcttctctatttggcaaatgtgaacaattactgggggaacaatggagtctggaatttatgggccagcctctctcctggtgccagtttctcagcccttcagcacctgctcttgatcagacccagtccttcctagccagctgctccccacgtgctgctctgaagcattggggagtaggggtgagccttcttgagaaccatggcttctgaggctttctccagggaccaccccagcctcacaatgctggcgctgcttctcccacccttccccggctgcatgccattagcagttattgctaagtagacacttgctatgtcgtcctcaacccactgactttctctgagttactccttggcaaagttgggtgttgtgctctgttgtgttactgcatcacgttgtgtctaggtggggaatttgcacgtgcacagtcatacccacactgcgatggaaaatgaggtttgagcaactgttcttcccccaaagaagcaaccggtgaggaaatgagcccacttggtggcttgttgtctttactttcagagccagagcaggctggcagccatcaccaagttagcatcctgtcatgtggctcaggcgggcaatgtttgcagattgtcccctgatgccatctgcctgtgaggctacaggaacccccagcaactgctgctctagcaggtgctggggctgctgaggtaggtgtccgtgtacatatattcaagcacacacagctttgtgtggtgtgcagaggtaccggtgttgggctagggctgagcttcgcctagttaggcctctgggacgccagttgaaacactcaacctagcaaagcgccagccccagttgttggtttccggtggggccctggtgagggaggaagagagggtgaggctgctgtgaacagaggcagcaactggggaattggatatggtaactaacacactcttgagtgtgcaggaagctgcggggagtggcattgttttgacaaacttttgttgctttctttctgcctctgccctctgctcgggcctagtcatggccctctacccaatttagcatctctgttccttccagcggggagcccatccccatttcttacctcatgggctctttttaaggagcgcattcctcatctttgagctcttcctgccattcagccatgctttgggtcagcccctaagctttcacttttccccaagttactgtgattatggattcagacaagcctagaaaatccttactcctttggggggaattcctgtatacagacttatactttgtgagtcactattatcttggtctaataatgctttttaaaacaattatgtaaattattaaagcaatttgaaataattatattagccatcagatttcagaaatctagatcttaatggagctttgattaagagtctacctagagcaggggtcagcgaactttttctgtaaagggccagatattttagactttgatctctgttgcagctactcagttccgctggtgtagcatgaaagcagctgtacaaaatacttaaatgcatgagtatagttgtgttctaatgagactttctttacaaaagtgagtggtgagctttcatttgctgacccctgatctagagtgataagccatccttattttttttctttgtcaagagttgaaaagccagaggaacttgatgactgtaaatgcattagaatcatcttcttttgggtttagtatccttgtgagcacaatggtaatttgggaatatgcttctttaaatctctgttgagaagaagataaatcagaaggctttttaagggggtgagtctgcttggccaaagcttgtcattgtttaacaagaacaggctgtcacttagagctgtatggtggcttttatgtttcactcattctctttatagtcacatggaatggccatagttacataaggtcgcctcaccatactggggcttattccactttataggaccaggtgcttttctaataaatgtaagaaaactacaaagatacagaaaatggtgtttttaaaacatgatgttatgctaagttggcattgctatagttcatttccagaaagatggagcttaagatagtccaagaggcattctaaagtttcaaactataatcttgttttccttttatctgtcctcacaggaaataaagaaagagatgaagaaagaccctctcaccaacaaagctccagaaaagcccctgcacgaagtgcccagtggaaactctttgctgtcttctgaaacgattttaagaaccaataagagaggtatggaaaaggaaaaagaggttccctccctgcacacaaacaaaagctggaaacttctggtgaactgtgtcaaactttatattgctgaaaaattgaatagagtttgtccttttggtttttggtatatattttggatacacacatacatacttggcaagtgactatatgtatagtaactgtaataaagggaactaataaaaatattttttgacagtgggaaagtagactacatttgtaaatgatgatttttctggagctgtagatttcactttcatatctatttttatggatgaaaggtgaatttagagaatgctgtggtgcaggcctgagccgtgtgtctgaccgcactctccctttaatttaaggcaaaccttatcaagttatttctctctccaactgctaggctccctagcgcagaccctgcctctctgagtttgtgaggcagaatgtgcaaagatatagctaacacatctgtctgaccagaagacctttaacaatcttgttttctctcttttgagacctcaaggcagattttcaggtatcagcttgttggagttttgttttttctcccatcccctcttggtgataattgtttgaaataatgtgagagagaatagaagactgcagagacgaccccactcaattttatactgtgagcacactagggtccctccgtttttcctgaccttggaccagccagggcacatgctgagcatgcctgtaggttagcgcttggctgccagcttttagtgggcttattacttccttaaagagaaatagagagctgtttgaaagcaggcacaggaactagattagcaaagggttccattaaccagaaaaaaagaaggcaagtttatataaccatggggaggaagaacagctaatctttcataaaatttagacaggataagaatttgtccagtaaactgcccattgatcatagctttgtgcctctcttcctttctgtctcttcctctactgcctccagctgccctgggttacatttccctttttgaattattcagatcaaatattggctggaggcccatgttggttagcagctataggattttctttcttttctcgttttgttaaattcatcctaccaaagcaggggatttcccattttaagaattaagtgccctttgctgtaaaactacagtcttgcccaaaagtgcctcctgcattcttgcaagtaagctctcaaactcctgagacctgcattcattggatttggtgaggtagagttcagtgtgtgttctttctgcactttcaaaccaatgagaaggagccctcccattcctccacctgcctcttgggtccgcgggcacggcaattgcacgcatgttgaccagcggcaaggcctctttggccagccatggtttttgtcaagtcagtaagagatttaaagtaattaattaatttaacaagataaggaattaattaaggtaaggaattgaggtaactatttggatgagtttagtaaaattacctgagaactttaaatcaacgaaggaatagaatttttcagatgattatctcttcaccactgaaaatctggcctctgagttcccctatggaatttttcattcaccaaaaattggaatgcagagggatggcttactgccttacattccattttgaaagctttctgccttggacctgcagcctggttatggccaacctttcattctgaggcattttatatgtggaatctgccggtggttgtgggacctgagtacatggaggcattctgtaaatatgaagtctataacaaatcatcttcattctgtccgaggcttcaccctgacctcctgggtcacctgggcgtaacataaatttccagctgaagggaagcattgtgtaccaggcccagggctgcctctggccctcccccaccagtcaagactaccagtattctgctaccccttataataaacagcgggggtagattgattggccttgtcaggccagataaatagttcattgtactgagctcaaaagctacatttttttcccacccaaaatcaatgaaaaaaacacttttttccccccttaaaacaaggatcagaggctaaatctgtgggatgattctagttacttgtaaacacttcggtccaactaatttttaaagttttatgagttaccataagtgactgaaggggcctccttcccctttgtttccatcatcgagctttgtctccagcaacctttcggatgttttggtctattactgttgttgtggctattagggaaggaagttgctttcaggatttattaacagcctgctttgattggctaacatgggatcttagaggatatgagttgagtccaccttgtgattcagtcttggacccttgtaagaatttaatagaatgaacacaagttctcttccttgaacttgatcaaagatgagatgactgttttctgtatatggaccttatcatttgatacatgcttgaagttggattaataatgaaagattgacatctatttctatcatgagtctgaaactgaaccacttcattgggtcctgaacttgagatagtcctagctgaagaagtttgcccaattgtgtccagctgtttttgcgtcttgtgacatgcctcactttgcagcaactgcaaacaggtagtagtccctcacgttgtgggatgagctcaccctccccagacacctgcataaggtcagaagacatcttgggtttgaaggaagctattcatagccttgagaaaaagccagggctatggaaaccttagtttggggactgattagtttcacttttcagctttaacgtttgtaaacgtctgcagagttgatttagggggtactggaatgactccatgggctttttttttctttctttctttctttcttttttattttttggaaacagggtctcactctgacacccaggctctcactctgacatccaggctggagtgcagtggcgcgatcatggctcactgcagcctcgacctccccaggctcaggtgatcctcccacctcagcctcctgagtagctgggactacaaggtacgagctaccacacctggctaatttactgatttttcgtagagctggggttttgccatgttgcctagctagtcttgaacgcctgggctcaagcaagcctcctaccccagcctcccagagcactgggattacaggtataagccactgtgactggctggcttttcatttgagaagatgatgtgactggaattgagagagagaaagtacatcctcccagctgacttggcagccactggctacacattctggcattagaaccttaggggcacttgtgtctgcactcacttctggccatttctgtggtccttacctgagtcacagtgaaagagcttcctgtttaaaacaagcctttcctgaggaataagaagtcgtttttcatttaaacttgcagcatggatgttgtatgttctgaagttatcccagactccagtatatcgatgagttaagccagaaaatgtgaaaactttacttggagccaaatgtcattctcttgatgaaccagacagaaaagagttgtatgttttcttcaaagaatgattgattcttttgtttcttctatcattaaacccataaaagagaatgatgggccctcctaaattggagcattgatatatagagacttttttaaaaaagcattcaaatgccgagattgtgccactccagcctgggcaacaagagtgaaactccatctcaaaaaacaaacaaacaaacaaacaaaaaaaacgcattcaaatgttgagtttagaagaaaaattgaataaaacggaagtttgaacagttagcatatatcctaaataggttcttgaaaatgaacagtggatttttgtccatttgaatatagactcttacctacttgaattaaaaatgaaataaaaaaatcaagctggacacagtgactcattcctgtaatcccagcactctggaaggctgaggtgagaggattgcttgagtccaggagctcaagaccagcctgggcaacatagcaagaccccatctctaaaaaaaataaaacaattagctgggtgtggtggcatgcacctgtagtcttagctactcaagaggctgaggtgggagaatcacttaagcccagaaggtcggggctgcagtgagctgtgatagcgccactgcactccagcctgggtgccagagtgagaccctatctcaaaacaaaaaacaaaaaaaagaaaaaattatttgatccttagaaggatttcctggctaactttattcatgtgatcagttaagtatccaggctgtcatcaataccctgctggcccgtgtgaggaccaggttccatctcagggttctcgtttgcactgttaacagtgcatgcagagaagatgtatctctgcctctctctgaacctctcctgttgcctggaattttggacattgttccttcctcactttttggtagacacccatgaacattcaatagtacatgtttagtgcatgcccactatgcatctgcccttgtgcttggtgatggggcagataaagactggaaaaacaccagccagtcctgcctgcaagtaactcagtctgttgtatcccttgggaaacgttgagaaagtgctgcacgtttcttatatcattttgatggcaaggtggggatgtgtcttgtatttacttctgtcattctgaatgtgaagccactccgtgggtttctggttggctttatatgtccttgtttctatttccagtttatcatgaattcagtgtttggtaagtctctattgtattttgcacatttactattttttgctatattattatgctctcctgatacaaaatgtattttatagttacctttttaagtcgctctgctactttggcatctgccttcccaaagataaactgcttttaccatctttatttaaggttttttatgcatttgcattttactgccccttccagagattaatgctgaaagatctgacggtttaaaagatgttatttgtaacaggtctagctctgatgctacgaggtgagatcgtctgtctcatgagattcaagttaagatgggggagggttgctctctgaattgatatgtgggtatgactgattgtagaacattgctctgtgggttcatttctggtgtgtttaatccttcagacgggttccattcaaaagttttccttaacagagggatcaacggctgctcttcctctggtgacacactgttgctttaaaagttagtgcagaagttcttccacattaatatggacctcgtgtttgccacatggaagggctctccagtttggtctgctacctgtagctgtcagaagaatgttgcttaatgtttacctttcttctcatagtttcagcactggtcattccaagccctaaacagatctaagtgactgcccgtcctttccccacttcccctgaaggggaaacgttttttctagcttttagtgtgagggcctggaatgcttctcatggcgccaaggcggtggcgtggatcttgataggccgtgagctctttggcagaaatgaaactgttaacaaaggatggaaagaagtatgtccttagtaaagaaaatgtcaacctctttggtttgccagtggtttgttgtttaaggtaaatgtgagatctgggggtttgtttgtagagatgagactttgtttctttcaaattttctattggagaaataaatgtgaattcttgccagttaactgggaatctgaaaatgtgccatttggggtcagacttttctttgagtttcaagattgcctgtttatttgacttaaggagctggtgtttatggacagatagaataagagttaacagaagacattactgttgtgtagaagctcttggctatcacctgagctggtctttcccaggggaaatgaaaatctggcgatctggcagtgaatggggatagatatgatacatagtcattcagtaatatatacgtctgtgtgaatgtatctgtatacgcatctatagtcttattttccagtgggccttcattctcaaaagctctggagtcaagagcctttaaagaagtcttttaaactaactgatccctgactgcatttctggcaagttttattgggacactgcgttgttagcaccagcaattgatgttggagtgtgtgttaccctttttcatgttattttctgaacctattgagcctagagtgaggggtggtgaaatgcatggtaagaactacataggagggtatagccatcatgttgcgattatgtgtgggtcattgataaaatcggtttttagatttttttttctgttatgtttaatctcctttctatctctgtgtcttctgatttcaaggcattaacactaatgagtctcccatgggttagtcatgggtttaagactcccgccatactcctgctggtgtccgcccaaatccacccagaggacaagccatgaagtgggtttgtggtggtggctccacctggtggctctcctaggaaactcctctttctgcccaccttttccttctccttgggagaatcttgatggaggatgcctttgattcctctgactcagtgttcactatttgtgcagttccatcccagacccacggcttctcacattacttatggatttttttagcccttttgctttttcgcctaagaattgctctttgaactcatataatctgtgtcctgatccttgttctatctgtgatacccctatggaccaggattattgttaatgaggattaaaaaaaaaaaaggactcccataggcatgactctagatatagatattaatttggacaaaataaagaatcacactgaaatccctgtaggtatgtatgccaaaatctcctgcctaatagctccaagtacccttatctacttcttcttcactttttgttgaacccatttttcctcaaaggagcaatattttattaccaatgttgttttcaattgtcagcaggtggcgaaagtaaaaagccaactaactttttggcttcattgttgtttcattattgtttgtgaattctctacaggcagcccccttcttgcctgggcacagactgcccccgcttggtatgtcactgagcataagtatttttgataaataaaaatgtcttttattctcattatttttcagtttttagttgttgataatattgcagatatgacttattttagctgcattgtgggtcagtctgggaacttaatcaccatttataactttgcttctatgggaataatgcattcagagttccaaactctctgcataaggcacatataagtctttttttttttttttttttttttttcttggaggcagagtctcgctctatcccctaggctggagtacagtggcatgatctcggctcactgcaactttcgcctcccgggttcaagccattctcctgcctcagcctcctgagtagctgggactacaggcacctgccaccatgcccggccaatttttgtatttttagtagagacgggatttcgccatgttggtcaggctggtcttgaactcctgacctcaagtcatcccccagcctcggcctcccaaagtgctgggattacaggcgtgagccactgtgcctggccaagtctgacttcttttttttttttttttttttttgcattgctgacatgaatccttaagtacctttgtaaaagtcagagtccgtataatcggtgcccactgaagtttgctcatgttgcagaggagtttataattcacacagtatagaatgctggaactgtgcaagctccacacagtacactaggctctgaggatagctttgggttcaatcacattgcaccattgtatatggtgcttattttcacaaggcctgagttggatcttagtgtgcccacgtttgtatgaggcatgtcgtgaaagtgggtcctattgtatatttccatctactagtgacgagaccttgcaccaagcgtgacatgctcagatagaaaccagcccagcatttctcagtgtgtgttgtatggaattatagcccttctgactattccacaaaggagggatgcggggagagacaggcagacaagcggggagagaaaattgcctctctcgtcaaatttcagctgcagcactaacaccatcttggagactgacaagcacattagcatagtacaggctctcagatggcctatggtaaggagacctgcttatctttgatcatggaactgcatgttattggatactagttaagactccactttgggatatgttgggctttaagatacaggacaaggagctctgtaagcatccccaagataatcttcaggttccacctctcatgggaaatgtttgagtaagtgagtggagatggtggtgctggcactcagagaaatgactggcgaggcttcttaagcctgcgctgtcaaaaaacatgagttagatgatgctaggagaacattctttgaatctgaaacttgaaagccagtcctcttggtagtttttcaagtgacaagctgaaagggaattttccctctgatcatttcttgggtccttgtatctaagaatgaggcttagacacatgagtggaagtcctagtctgggctttggcatgaaaagcaggctgaggggacccaacctagcaactggtgaggccagggtgttcaggtctacctgggacttggatcacgatggaacctgcgattccagaggtggtttttattatgatgacagtctctacatagtcaacatagtctcattgccttctctacttgctttgactgaaagacagaagtcttagcttttcccgatgccattaaaacactgaacgtttataaagaagagccttcttctctccctactagtgaaacaggctggcatttgagttcaagtaataaatccacatgtggggttgtgaggaaaaaccacatagcctgcctttttagaattctggaatcacagagttacagaggttacagagggacccacttattgacatcccaggcgaacgaacatggagcctctgcccagggaattgaaaaggacactccttggctctggccttggctaagccccacgtgggagcctcctttccaaagggaagtttttctgggtagggaactgctagattaatgaaaggtaatcaggccaggtgtgatgacttacacctgtaatcccaacactttgggagggcaaagctggaggatctcttaagcccaggagttcaagaccagccggggcaacatggtgagatgttttatagtctctataaaaaatacaaaaattagccgggcatggcagcgtgtgcatgtagtcccagccacttgggaggctgaggtgggaggattgtctgagcctcggaagtgaaggttgcagtgagctgaaatcgcaccactgcactccagcctgggtgacagagcgagaacccgtctcaaaaaaaaaaaaaaaaaagtaattagaggtagatgatatttaggtgctggttgcatttgttgcattatatggggacagcagctatattcacttgcagtaagctctggaaaaggggcattttcttctaattatatctgttgatctgtcatcacagcctggtctctctgatgccatgtgcagcctcagcttagtctttggattcttggctttttgtgcttctgaagccttaagactgttgtacccaaacaatgaggacatttcatggcccacctccctaactcatgattaggccaacagcgggcccagctgcagtgccaggtgggctgccctcattgtttcaaccaggaagggaaagagagaccagccagaagcttcctctgcatgtgcctgtgcatgaaaaagagcatttgaggaggactagcctgcttgtcgcatttgtgtttctctggagacctgaataggttcagtggcagcaggaccttattgcagggaggatggctgttgggaggacccagaccactcctgctgcacctccacagcttctgcagcactttagacaagttgcagattccccctgtgtttccaggtttcccatttgtaaaacaaggaaatgctcttgttaattccttcagggcaattgtgaagattaaaaatgagtaaagaaaataggttttgggatagggaggcaatagagtgaagtggggtagggtgtcactcactgaatacagtagtaattgctattaaaagtagtaaactgctagtaagaccccagagcattgggaaggaattagagatttatggaaaataataaaacgtgttttcatgaaacaacctgtgatcacatgcacatggcaccttctccaggatggaccatatgctaggctgtaaaagaagtctcagtggccaggtgcggtggctcacgcctataattccagcactttgggaggccgaggcgggtggatcacaaggtcaggagattgagaccatcctggctaacacagtgaaaccccgtctttattaaaaacacaaaaaaattagccggtcatggtggcgggctcccgtagtcccagctacttgaaagtctgaggcaggagaatggcgtgaacccgggaggcggagcttgcagtgagccgagatcgcgccgctgcactccagcctgggcaactgagcaagaatccgtcccccccaccccccccccccgccaaaaaaaaggagtctcagtaaatttagaaggattaaaatcatacgaagtatattctccaatcacaatggaattaaattagaaatcaacaatagaaggaaattggggaaattcacaattacatagaaattaagcagtatgctcctaaataaccaatgagccaaagaagaattcacaagggaaattttaaaatactttgaaattaatgaaaatgaaaacatgacatacaaaaatgtactgcctgtggctaaagcagtgtttcaagtgaaactgacagctgcaaatgcctatgtacaaaaagaagacagatctcaaattaatagcctttctactttctactttaagaaactagaaaagaaaagcaagctaaactcaaagcaagcagaaagaaggaaatgataaaggttacagtggaaataaatgaaatagagaatcgaaaaactatagaaaatcaatgaaacaaatagttgatccttagaaatgatcaacaaacttgataaaccttatctacactgatcaagaaaaaaggagagaagatttcagttactatatgaggagttaaagcgcgaacatcactaccaatcttaagagaaattaaaaggattgtaagggaatagtatgaacaactcacccactgctggtggaaatgtaaaatggtacagccactttggagaacagtcacccatatgacccagtattccagactctagaaaaatgaaaacatatatgtccacacataactgtacatgaatgttcatagcagcattattcataatagccaaacagtggcaacaacccaaatgtccaccagtggatgaatggctgaacaaaatgtggtctatacacaaaatggagtatcgtaagaaggaatgaagtcctcatatatggatgaaccttgaaaacattatgctaagtgaaagaagccagtcacaaaagaccgcatattgtatgattccattgatatgaacgtgcggaataagcaaatccctagagatagaaagtagattagtgtttgcctaaagctgaaggtgggaatggaaagtgatttttggtgggcgtgaagtttctttttggggtgatagaaatgttctaaaattacactgctgtcatggctgtacaatcctgcagatacataaatccatttaattgtacacttgaaatgggtaaattttatggtatgtaaattatatctcaataaagctattaaaaaatacaacacaaattggggttaaaatgctatgtctgtctgtctgcctctttctcttttatgtcccctaccactaacctccttcccacagctgagggacaagatgtgtcattccatttattcaagtctttaaaattatatatttctcagcaaagctttatatttttctttattcaatcagttgcctaggagatagtaggtctgagggatcaaaaagacactgttttgctaagggtgacccaaatattagataatcgatttgagaagggtagagaactggctgtggcatcctattgttcatttcttgagaaaaaaatgagattctctgtaaatcaaaagccaaacctcttatattctaaattctgtgcttcgtagaaagagcctctgctagaaaggaaagaatccatttatgtttccagtttttcttgccgttgtcagtaactgcgttggctatttttgctcataaatctttatccacagctctgatgatttctttaggaaagatttctcagatgtggaattactggacaaaagtgtgtgtatattttatggtacttggattcattatcaaattgacttcctgaaagcttgcactgatctgtctcactactgaagtggggagagtgctgcttagtgttctaagcttgaatttctcagattaatcgagtgcttgaacattttttcttccgtcatttgttaataatctttgcactttatattgaggtccttatttttttttttactggttggtgtactattcctttgtcattcatggcaaattttgcttcccaatttgtttgcttttcattttgtttacgattgattttgatgcacagaaatagtaaatttttatgtagattggtatattgatgctttcttttgtgatttctctgaataaattatcacctagcttatctcctttttttatactggcttcattttttacttcaaaattttaatctgtatagaattttgatgtgtagtatgaggttagtatacaaattgatttttattttgaaatagccacttttccaggaccatttattgaatagccctttccagtgattgtatgatacctcatttatcatataatattattatatatatgaaagtctttgggctttcaattctataccattaatttgttttaccattcttaatatggttaactattatggctttataatatattttaatatattgtatggcaagctttcagccttcctatcacccttcattttcaaaaaggatttagttactctcatttattttaaaatcatgtcatcaagttaaaattttaatttcattcaaattataagtcacttttagaagaattaacatttttctaacatttttgtttaaagctttgcattgttgcataaaccaactttatatacaagtatataagtgaaaaccttttctcccccacctctcctccccaaacatcacagtaggctaattcttgtaaattaaaacatctatccccttctgaattctaaacagcttattctagtcagccagtgacatgggatgtcactctgttgagtcaagtgttacagttttatttgtgcagtcttgcttgttgatgacgttattcccagatagatagtggttattgttggcttttgtaaataggatctttcccctcatattttttgtattgctggtacgtagaggaatttaacttttgaagatttctttacaatagcccttgtggaacactcttgctaattaaaaaaagttcctcttttatatttagaaaattattagtacctatcagtcactagttttcagaaggtggataagtggaaattataaaatgctgtatttgaacaaatgatattttagaaacaaaaattccttggcttggatagaacgctgtgtgtgtgtgtgtgtgtgtgtgtgtgtgtgtgtgtgtgtagggatttttatccaaattaaggaattttatatatacagttgacccttgaacaacacagctttgaactgcacaggtccacttatatgtagatttttttcagccaaatgcagatagataatacagcatttgtgggatgccaaacctgtgtatacagagggccgatttttcccgtgcttgagttccacagagccaattgcgagacttaaggatgtgtggattttgggatgcgctaagggtcctggaaccaatctgccgggaatactgagggatgattatatatgtatatatatgcagctgttaacagtgttatattgtatatttcaaaataaacagaagattttgaagttttcactacaaagaaatgataaatatttgaggcgatggataagctaaatacccttacatgatcattatacaatgtatacatggatcataacatcacactctaccccataaatatgtacaattattatgcgtcaattgaaaagaaaacttaaaaaagtggacatgtgcaaacctcaaaaaaaatcaaaagctaactttcattagttcatattatgaaaacaactgtttttgtttggtttttcaactatgacagtatattaaatgaaaaaaggaaaaccttagtcatctgatcttaatgatttgtaatctgatcttagtgatctgatcttaaatgaatttttttatatatttggggctgcatttcattctattaatgcatttttattcttccgcaagtgttgtgcatgtttaggtttttattttctttactagattataaggcgcttgaaggaaagaaaccacatcttattcatcttggagctcactttaattgttgaatgaagtatatgcttgtactcatataccctaatccttttgaaaaacaagttacttcaaggcaaactaccagagggagaactaacttattaagttacatggttaaggggaagctgttgaaattctgtgattcagagaaattgtctttggtttctgagtaccgagggagagaggagacttattaaacatctgttttaagagtggatcctagaataagtactaaacctaggtcttggcctgaccacaggcagtttactagagagagagaaggtgaaatagtttcagaggaggaaattgcaactagatcttgagtaatgagattgaaggtggagctaagttagaagggtaacactgtgctcaaagagaagggtcctaaaattttcacattcacttgtgtaacatgcgatggcgagtgcgagaatgtatacaagacaagggaaggtttcaatttcatgtgaacattttaatctatatttgattttacccttttgcccaaggttttataaatgaaagtgtaggccgggcgcagtggctcacgcctgtaatcccagcactttgggaggccgaggcgggcggattacctgaggtcaggagttcgagatcagcctgggcaacatggtgaaaccccgtctctactagaaatacaaaattagccgggcgtggtgacacatgcctgtaatcccagctactcgggaggctgaggcaggagaatcgcttgaacctgggaggcggagggtgcagtgagctgagattgcgccattgcactccagcctgggcaaccagagtaaatctccgtctcaccaaaaaaataaacaaataaataaaataaaataaaataaatgaaagtgtatagagttcagtttattttctatatagatgtgtactcttccctttttgttggagtacatgggccagacctagcttttccttcatttctgggcttttccttctctgatatttgattcctcatcactttcatcaggaccagggagggaaagttaattttggactatgtgattatgcatcagttttgcctgtcaggaacctagtattatgaatgattaatgattagtattgttctaagatttcaatttaggtaaaatttatctctctaaccacctgcagcttgcttgttgaagattctgtaacactagagcagggaggtgacaatccctgtgggggtggcctgagaagctcttttctcccctcccacccttagtctcttcttgcttctttttcctctctgcccccttcttttctccctagggcccacttggatggattctttggtattgtcattccttacaaaggaaaataaaaattcccagatagtttgccactgagttttccctttaattattttacccctttgctagcccacattatttgagagattaaagcaaacaaatgaacacagcgtgctgcttaatagttatttcttttatggaaatagagttctgctatgttgcccaggctggtcttaaactcctagcctctagtgattctcccaacttggctgctcaaagtgcttaatagttattttttttaaatattgtttagggaaaaaatgataccagttgttttatatttgaccttttttaaaaaaaagctttaaagcagctctttgataatatcactagaagtagtttatttctttttgaagaaattagcttcctttgtaatttacttttgactacatcattgagataaaaggtaaggcagttgaaactatgtacaaaaaggaaaaaaaaaatcgctcagttactgatgggtctggcactgtgtggttagggatgggaaaaccagcatacactagaaatgaaaatcctgtttctatttcatacgtatacatatactttaaaaactttacatgttccctcctaagctttggccctgtagctcttgcccttcttgcacagaactcatgtgcaattcacattaatgttgaagagactcctttcctccctccttctctcccttcttccttctttcctctgttcctttcttcctctgactctctctccatccttctcttccatactttctaaggaccatcccattctggagtgggcccttagggtgtgggtatatttaagtgtgtgtcattagctcttagttaccttttcacagagttgatgggaataaaatggaccattgaaatccaggaatgacccacagaaatgcttttgcagtttaactctaaacctttttattagaaaggcttatataggatgtgatttcacttttctcacttcctgctgatcctctcaggtggaggtgatcataaatttaaaaatgaccaaacctaggcagcaagaaggaagagaggtaagcatcagctggggattttgtaggatcagtctctctccttccacatgttcataaattatgaactgtatcgatccattcacattgatgtatgaactcattctgccaaaagcccaagttgaagtggaaaatggaaagtgatcatttattagagctgatgagtgtcagctttgtactgaaacaaagaaaacgaaaccacacaggcctggacggcctccccttcaaccctaagattctgtggccagaggcaagtgggcctgggggtaaccagcaagacttagtaacagtttacaaatatcctgcctgttttcagtggcttggaatcagactgttatctccttgaggctggaaaagcatttctgtgcctttatctccccatgacttctgcccaggatgattcagacaccctcactggaattatcttcatctgaataattctcagctctatcagccattatcaatgttgggaaggttatttcacctttttaagcatcgatttcttcatctgcaagttgaaaggttgagaagtttctagtatgtcttcagctgggcatggtttctaaaagcttttgttcctatcttcatcagaacataactagttctccagttcagggtcatggtactgtttatatagagtcctcaaagcattttaacctgtgagccctcatttggttattaagcttttggaaatgttgaaaagcttaagcatcccacttctctctttgcaaaccctccccaacgttcccaggaagaaatattggggtccagtctgtgtaccatcagcccattctagctcctacagctgacaaacatttgttgaacaaatcaagttcccacatgaccagtcagaagcctctggagagcttcaaagaattctttgctgagaatgccccatggtgattttgttgagtaatgaagttaaaataatgtttctgtctttggtaaaccacccattctcacctactgcatggcagcatgggtttctgccagtctttactcagcttgattgcacaaggttgggcaggtggtgagatgtgtattcactttgccttcagctcagcatgcttcagaatacaggtttagcatcccaaatgtgaaaatccaaaatctgaaatgctccaaaatctgaaactttttatgtgctgacgtgacgtttaaagaaaatgctcattggagcattttggatatcagattacagatactcaactggcaagtataatgcaaatattccaaaacatgaaaaaaaaatctgaaatccaagacacttctggtcccaagcttttctgatgagggatattcaacctgaactgcctcttccaaaggcttttgcatatcatctccatatttatttcagtgggtgtgggatagaatcacaaattctagctgccagttccttctcctcaacctgttagatgatagctaaagattgctagctaagtgatacttttttatttgagatggtgtctcgctctgtttccaggctggagtgcagtggtgtgatctcggctcactgcaaccgggttcaagtgattctcctgcttcagcctcctgagtagctgggacttacagtcacgttccaccgcgcccagcacgtttttgtatttttagtagatactgggtttcaccatgttggccaagatagtctcaatctcttgaccttgtgatctgcctgcctcggcctcccaaaatgctgggattacaggcatgagccaccacgcccggcctaagtgatattttttaaagcatgtttaatatttcaaaatgaggttttaacagagacacatagaaagggatcaacaagggacttgaacaaatatttgcacacccacattcagagcagcattattcgcaataggcaaaaggtggaagcaacccaagtgttcattgaggatgaattgataaacaaatattatccagccttaaaaaggaaagaaattatgacacatgctgtaacatggatgaactttgaggacattatgctaagtgaaataaaccagacacaaacagacaaatactatatgattccacttatgtgaggtacctagagtagtcaaatgtatagagacagaaagtaggatggtggtttgcaggggctgagggagggataatgggcagttattgtttcataggtatataatttcagttttgcaaaatgaaaagacttctggagatggatgttggcgatagttgcacaacaatgtgagtgtacttaatgccactgaactgtacacttaaaatggttaagatggtaaattttatgttatgaatgctttaccacaataaaaaaggatcaagaataacatgacaaatacccaacacccttctacccactaccagctaagaaattctatcaattagcaattacagttgatctgtcatgtatgttaccttgtctcagttgcattgtgtgtgtttcttgagaagcgtgatggatgacttgggtaagagaattctgggtcaagagagcattccttctcctgttttcttttcatttttatttgttagttaaagataaacatagtacaataagtaaaaaattaataacctttctctgtcctttaaaattagtgttcctaactctaaaaagcaatgtttctagaaacttctgtttaccctttgggctctgatgaatgtggagaaaagagagagaacacttaactcaccaggatggaagaataagataaaatatttgcaacctccttcctccctgaatgttgtgttaaacgtttttttgaggacttgcgctgtgtcaagtgttgtcgtatcagttatctattgctacaatattgctgcataacaaattactacaaaaccccagcagcatacaacattaagctgctctgtgtatcttgcttgcattatgtgtacaacaaacccctatgacatgagtttacctatataacctgcacaatgtacccctgaacctaaaataaaagttaaaaaaaaaaagaattaggaccttaatgcaatcagtacgccctagttacctatgcaaatgttgtagtggagacatctatgcagtcctttaaacaaccctgagaagtaggtggcattggcctcattttgcagttggaaaaagcaaggctcagagaggttataagacctatccaaggccacactgttagtgagtggtgtagtttgggtttgaacctgggtctgtcagacgccttcctccatgccgcctctgccaaactccatgcagcaccttggattaccacctatggaaacattctgttttgccttttgtgcttctatttgcccctcccactcccgctctactcctttctctattatatttgattgagtcctcttctccaacttctgaagtgtaagctgtttctatagtcctgtctttggcatcttcctgggttcagctaatgccatgaagcatacgattccctaagcccaacctctaggctggccctccctccttgctgccttcatgtccactctcagacactctgtgctggctactggtttctgggctgcaagtcataggcaacgtggttccatctggcgtaggtcatgaggaaatacctgtcttgtgtaacaggaagttgtacacacacagggcaggcttgtcagggcccaggtttcttttctgtgccctgcctctcctggagttggctttgtgctgtgaccagcaagtggagcaacagtggacttcccagtttacatccagtggggaagtgcaggggacctctcttcatttagatgctctgggcagacccacctttgtctctcactgtaccaccctgacctaggactgcctgcccatccctgaacctatttctggtgggagctgacccacgtctggtggtctgtggtggagtggcagatgggagacagtcactgtgtccccaactgtccctatgtggttgagcagcagattctctctcctgtcagactcctgttgcttctgtattctgcattttatttgtttttatttatttttttgagacagggtctcactctgtcactgaggttggagtgcagtagcggaatcatggctcactgcagcctccacctccagggctcaagcaatccttctacctcagcctacccgagtagctgggactacaggtgtgtgccaccatacctggctaatttatctattttttttttttttttttttagagtagagacagggtcttgctatgttgcccaggctgggttcaaactcctggtctcaagcaatctgcctgcctcaacctcccaaagtgctgggattacaggtgtaagccaccgtgctcagctgtgttctgcattttagttggtggcattaccaaccttcacttcctcccatcgacactttggggtcatttttaattcttctttcttcttcatccccttatttacttacatgttttgttctaactttgtttatgagatggttgttaaaggtctgttctgggctagcctgtagtaatccccaaggaggccagctgagttcctgttcacagagtctaggatttgagaatcaaacaatccccaggcagcgtgggcagggtaaagagaacattatacactgggtgctgtgctctctcatggttgttattggtggtggtggttgcaggggaccataaccctgcctcaaaagcagtcagggaaggtgtctgggagggggtcacatgtaagctgatgattcaaccttagccatgtctcttgttcttcctttttaaaaaaatattccctggtttctgatttggactcttaacacttcttcctataaaccagaagtcagcaaacgatggcccatgggccaaacctggcactggctgtttttgtaagtcaagttttattggcacacaggcacacccattcatttatgtgtggtctatggttgttttcaccactacaatggcagagttgagtagttgctacagaggccatatggctcacaaagcctgaaacattgactctctggccctttacagtaatagtttgctgatctctgcggcagaccattagaaaaaccgaattcctgcctgccgggaagtttcgtcttgcaaaaagagatatacgtaatatatagaaaattttataataaagccctttgaggtaaagacaattaagtgctgaatacaatatttaaatgctgacaaaaattattgttggggagattaatgtggatttatttttccctactttctctatttttctctgctctttctctattctgcaaatgaatcttcattcattttttttcgcctcaggatttttagactgacactttctagatttataacttctaagtttacacttttcatgacactcactttctgccctctgagagggggaggaaaggtatggatcagtttggaaaatgaagtctgggtgagatataaccccctcttttaaaaaaatacacctttgcacctttcctgtatttacaaggaaagtgggatttgtttaaataaagagaaaagtctttatctgcttcgaataaatagataggacgtgcattactaacctgtttgtttggtggggtcggcgggggacatctgcttaataatctgcccttttctggatgatgcttattccccaccccaccaagaggggactgatttgttgtttttctgatccccacacaatcatctgctcagtagggcagcttttgtgctattgggttgtttacacctctctgctcttttaaaacattttctagtttgaccttttcttttagactcatcctaacttttcttagacttactataaaaataatacatgtttagtgtaaaaaattaacagagtcaagtcatggtgtaaagagtcacatcaaatcccttccctgagtcatacttcctggaagagacttggttcatggtcatccctacagatctctgtgtagatattaggaggaaccataagcagatgcagatagtcatttgatcataaagatgtcaatttcaaacacatagtggtacatacatcttggcattttttaaaaacacagatgggatcatactgttcaggctatattgcaatttttgtattaagttgacgagaatcttggaaatcttgccgtatcagttcatttagagctatgcttctctttgctagtttgtgtggagatacacctatggcttaattaaccagttccctgattgaaggacgtttaggataattctggtttttcactattctgactaatgtagcagtggacattatgcatatatctttgtacatttcatgtgagttatctggagtataacttcctgaaagtggaattggtgttttcttgactcttttacttttaacacttttttttttttttttttttttgagacggagtctcattctgtcactcaggctgaagtgcagtggcgtgatcttggctcactgcagcctcaacttcccaagctcaggtaatccacctcagcctcccaggtaactgggattacaggcgtgtgtcactacgcctggctaattttgttttgttttgttttgttttttgtggagatggggttttgccatgttgcccaggctagtctcgaactcctgagctcaagagatctgcctgccttggcctcccaaagtgctgggattacaggcatgagccagcatgcctggttgagacattttttttagacttcttttttttttttgaagaactggtcagatgcctctggtcccagctggccatgctgaccatagggtccttcatcctctagtgataccacagaaatggacctcagtggaagtcaggcaatccctccaggcagatcctgtgcaattataaacattagcatcaacttccctccttctatggaatatttctgtgcttgcagcccggcaggcactggggacggacacacacacacacacacacacacacacacacacacacacacacaccagtgcgcacgcgcacacacacacacacacacacacaccagtgcagctgagtagggctgggagcaaggggtgtgtatgaagccgtgtgggtacatggaagccctagtgacctctttatacccgaaggatagggggaaacttgtagtgctttccagaatttaagtagtcagaaaagggagagaaaagtagggctgagttgggggagggtaatgaggctgtggcaggtgtcagcctgcaaattagctgtgctggcctccctggaagaaatcatgggcattgagctcagccaagccagggcaccagatgacagagtggggctctcgccagccactgacccaagtaataagagggcacttggcaagcagcttcatgagcaccgtgccacgtggccatttgtggttcaggacttgcgaagttgcccaaagtggctcttttgttatgatgtgttactccaaagcttatgaagcattccaatgaacagagtccaaatgttatgtttactgctttgttaaatataaatagtttacccttgtacctttgggtttccttggaaactgtaatttttttaaagataggttcttgctctgttgcccaggctggagtgcagtggtgcagtcatggctcactgcaacctagaactcatgggctcaagtggtcctcccatctcagcttcccgggtagctgagactacaggcacacatcaccatgctctgttaaatttttttatttttattttttgtagagacaggttctcgccacgttgctcaggccttgaaattctgccctcaagggatccttccaccttgacctcccatagtgctggaattataggtgtgagccgctgcacccagcctggaaattacaatcttgaaagcagggattgggggttctttttatttaaaaaatttccatggaacctgtttgccagtctggtgaagcctgtggaccccttttcagaataatgttggtaaatgaataaaaagggaaccaaagaattacaaaggaaaccaattatgttaaaatagttgtcaaaatagtacaaaaatacaagcaagacatatgctttattatagcaacatccagcagtgggtcaggaggtgatcataattttgaagcaggggtgagtgtaaatgatagttcaagataactgcaactgtgaaatgaaatgaaaatatctattcatgtagtgggaaataaataaatttcatagatgctgctagtaccattgtggtttgttgcttagattcacggtgagaataaaggccaaatttcagaagatagtaaaagatgtatttttcttcccatgtaagtttagaccccctgaattctatccacacaccccagttaaggacctctgcttaaggggtttagcctttcagattatgaggaatgaattgcagggatataaactcccatttgcatcaagaaaattcagaaatacctaggcttcctcccctctttattctgatggggatgagaagggaaactatattaaaaatgagtcaaaatttaaaaatattatgactacctgcaatgaagatctccccctacccccaaaagagagggtacatgtggaattctttgacactttctaaatctccgagcacagtggccatttttggtactgattttaaaaactgggaaaccctagatttgtttatggtgtgtatctcccacccccacaacccacacacacatacctcccagtaattctctaagattaggcaagacagaagtatcccagatgaaggtctttaggattttctagacctttgttacagttcttcaaatgtttgtgtctttttttctcctctcctacccctcattccctcatcttttccccctccctgcccattctacctttaactgtaaaagttaggtgtctgatatattcatttgtcagcagcaaagtttgagaatgcctttaaaaatagatatgttagagggagtatgttggatagaaaggagaaatcttgtttatgctcaataaataacttacatttagaaccttccttcaatttttcctttgaaattctgtattctcatttcacttgaatgactctgcatggagcgtttaaaagtagatcaaacaaaaccctataaatatgttgagttcttttgggcattttgccaaaattagccttgcagggaaaagcagtgtgctttacgtattggattttctcctctgaaaatccagactccctctcctctggagagctagctgccagggctgggggaaagtcaagccagggacacattagggaagtgtccctggtatggcctgctgaggttgggttatttggattgagggttgtgctgaaaggccaaaaccaatgcctgggaccagcctgaagaaagatgaaaagcagagggacgtttagagacgtcactgattttatgttatgacgtgattcctttatctcactctgattggaagggaaggctggtgaaaaaaacattaacagagctgtcttttaacagattcctgaatgtaaagccaaatggaaaaaagggagagagtcaggtggaagtaagccccttggaaagtaggtctgtctccatcatcccaattttatacgtgagaaaaccgaggcagagagccacgcaggggttgcaatgctgggtgagttgggccgtttgtctcttctgtattgttaactcagggttctctattattattattattattgttattattattattattattattattattagttagaggtggggtctcactatgttgcccaagctggtcttgaactcctgggctcaagtgatcctcctgcctcagcctcccaaagtgctaggattacaggtgtgagccaccatgcctggccccagggttctcttttatgtgctttaatgctttaagtgaagaccacgtatccatgagcagtgaaatcagagcccctgcaccctttcacatggctaattcacatatcatttttataagatatagttgaggtggaggatgttgagttcttcatgctcatggcaccaaaattacagatgtggcttctaaagaaatatcagatgacaatgttaatgttaaaatatacatatacagctcctctttgcagaaactcagtttattcaatggatggcccctttgactattacgttggaagtagaaacttgatttgggggggtcagatgttaattgcccaaatttaagacagttttcagtgacttctttaaatgaggcattagactctgaagttcatagggctgaggagggcctggatcggggattttctagatatatggcacctggggtccacatagggatctagagtggtgcagtggcatcgccctaaccatcatgaggcagatgtgagtgagtcgaattggttgatacagatgtgcgtgaaagagctgagaggtgtcagggttgaaaagatggagacagacagcaaccgacactcacagataacaaaaacacaatggaaggaggacagtgctagagaaaagcaatggttgttaggagaacccagagaaggggcccccacggctgaatgaatgagtatgtatgtgtgtgtgtatgtatgtgttcccatgagtgaggggcgagctcggaagatggacaccacagggcccctccacctagtgagagatggctgtctgggctgtgtaggctggtggtgtctggccagggaagataaccttggcttggtcactgatggaatagtatgggcctcctcagggttctgtaacagcatctgatcagaataatgactaatgtgggctacagatgtggagccctgtctctgagctcacacctcctgctgtgttcgtagaccagccacaaccagttgtcattgggaggtccgaggccccttgtcattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtgatgtttttaaaaagtgattacagtatattacgtgctctttgtgaagacaaattgatattgtagaagcatttaaatgagtttctacccttcccccaatctgcctcccctgaagtatcactgttactttggggtatagccttccataccattttctgtgcttacacaagtgtgtccgtgtacatataccccctttctctcattcatttgtatctttttttgagacagtctcttactctgttgccctcattcatttaattgtattagaccttcataaattagttgaatgttgaatggattcatttatttattaatgaacatttgttgaatgtatactctgtgctaggttccgagttatcaggagtaactaaaatgctacatgctgcttagagttatgagtgtgtgtgtgtgtgtgtgtgtgtgtgtgtgtgtgtgtgtatttataaaattgggatcatagtatacatattacgtgatttagtcttttagtgtactatggacaccttttcacactgatacacgtagagctacttgttatatttaatggctgctggatataccttcccctcccagtagacatccaggtttcacatgtagatctctgtgcatatatgcatttgctattagaaacaatgctgccctgaaccttcttatacatatatctttgcctacttaaaccaaatgttttctgtcttttaaggggaccgaatataaaatcaaacatacgtcatttcttgttcatatatagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactagttctacattttctcttatatcctgccaagacttgggagaaaatgagcactggcatagctatacccacttgtcagatgccctctgcctttgaagtagcaggcaaatggatttcctgtgttctgcggtgcagagatgttgattatacacatccctgtgaaaatcaagcaggctcatctccagggaccacacaatgctggttaattaaatattatacatttccactgcaacagtccaggtacagccaagaggggtttgtaaagaaacacccacagggtccttttatttggagtgccattggcttctgaagtgtcctcctcttcctgtgagttgcattatgttgaaacaggatgacgagtggaaatgtttccagtaaagagtatgatgcaggggttctgcaagatcggtaaatctaccttctcttcccttgtactcggaatctactggacgtcccaagtaaaaaatgtgtgaatctatacatttagttaagtttgtattgttttctccatcctgagatagaaaacatggcttcttgcataaattgaagtttccaactcaagaacagcctttaaagaagctggcatgctgctcagtaactggggagttgctgccttccccccaccccctgagcccctggcacctagcagtgtttgttaatgaatcatagcagagacgtccatcttctccactctcctgccccaacccaggaacacatttccagagctagaaactacttactgcaactgttccaaaggtctgtgaaataaacatcacagcacagcagcattcacctgtgctatgtattaaatactattgtcagatatttagaagtctgagttctctcccttgtgggaaaagacaccgaatgtaggacctaaaataacctgatcctggaagagtcccattcgtttttggcctgatgctcttctttgggcaacagatctgactaggtgtctctggaccttggctgcacattagaatcacatggggatcttttaaaatccagatgcccaggctgcacctcagaccaatattgacatttgaatctctagaggtgggtccaggcattggtatttccccttaaaatttttaatcagaaaatattttaatgcacagaaaatttgaaacaatagtacagtgaacacccacctagatttaccaattattagcattttgtcacatttgctttctatctctatcctctatccaatctccacacatactctttttgattactttttttaatcattgggatttttggcgttttttttttttttttggagacaaggtctcactctgtcgcccaggctggagtgcagtggtgtgatcacagctcactgcagacttgacctccccaagctcggacaatcctcccaccttggcctctgtactagctgggaccacaagcacatgctgccatgccaagctaatttttcattttttatagagacgaagttttgccatgttgcccaggctggtcttgaactcctgggctcaagtgatcttcctgccttggcctcccaaagtgctgggattacaggtgtgagtcactgagcctggcctgatttttttccttaaacggtttgaaaataaattacaaacatcaggacacttcatccctaaatacttcagaatgtatctcctaagtatgaggacattctgctaggtaactgcgatagaattaacaactccggaaatgtaacattaacatgctattatctagaattagttcatattcaaatttccccagttttctcaatgtttttatagccttttaaaaatgcagaattcaattagagatcatacattatatttagttgtcatatgtctttactctttttaaatctagaataattctctagccttttaaatatcttttgtgatattgacttaagaaaaaaatatttctgtgcctagcttatttcacttaacataatgacctccagttccatccatgttgctgccaaagacaggatctcgttcttttttatggctgagtagtagtctattaggtatctataccacattttattttcttttttttaaataaattttatttttaatttttgtaggtacataggtgtatatatttatgggatacatgagatattttgatacgggaatgcagtgtgtaataatcacatcatggagaatggggtatccatcccctcaagcatttatcctttgtgttactaacaatccaattatagtcttttagtaatttgaaaatgtatgattaagttgttattgactatatcatcctgttgtgctatcaaatagtaggtcttattcattctttctaactatgttttttgtacccattaaccatccccatctcacccccgacctgctcccactacccttcctagcctctgataaccatccttctattctctatgtccattgggttcaattgtttggagttttagatcttacaaagtgagaacgtgcgatgtttgtctttcggtgcctggcttatttcacttaacataatgatctccagttccatccatgttgttgcagatgacaggatctcattctttctatggctgagtagcattccattgggtatatgtaccacagtttccttatccacttttctgttgatggacacttaagttgattgcatatctttgctactgtgaatagtgctgaggtaaacatgaagagctaaaaaggttgatctcgtggaggtagagagtagagaggttggttactggatacaaacatacagttagattgaaagaataagttctagtattcagtagcagagtagggtgactatagttgacaacaatgtgtcgtatatttcaaaatagctagaaaagaggaattgaaatgctccaaatacacagaaatgataaatgctcaaggtgatggacactcaaataccctgccttgttcactacacattctatgcatggaacaaaatatcacatgtaccccctaaaaatgtacaactattatatatgaataagaattttttttttttggctaggtgtgatgactcactcttgtaatcccagcactttgggaggctgaggcaggaggatcacttgagcccaggagttcgagaccagcctaagcaacatagcgagaccccatctttacaaaaaatacaaaaattagccagtgtggtagctcacatcggtagtcccagctacccaggaggctgaggtgggaggatcacttgagcctgggaggtcaaggctgcagtgagccaagatcacaccactgtactccagcctgggcaacagagtgagaccctgtctcaaaaaaaaaaagtttttaagaaaaaaatcagatgagttttttgtttgtttgttttgttttttttgagacagagtctcgctctgttatccagattggagtgcagtgggacaatcttggctcactgcagtctcctgggttcaagtgtttctcctgcctcagcctcccgagtagctgagactacaggagtgcgccaccatgcctggctaatttttgtatttttagtagagacagggtttcaccacattggccagatggtctcaaactcctggcctcaggtgatcctcctgcctcagcctcccaaagtgctgggattacaggcttgagcgaccatgcctgaccagatcagtttttgtaaacggctcctcattttaaatttgcatgattgtttcctcgtggttggatttaggtaaatgttgtggcagaagtattctataggtgatgttatagaagtattctataggtgacgatattctataggtccttctcagtgcagcctatcaggaggcacgtgatgtcaatttgtcctatgattagcaatgttaacttggatcacttgggtaaggctgtatctgccagctctcttcattccaaggggaccattttccttttgtaactgtggggagatactttgagatttggtaaatatcttaatccccaacaagctttcgcccagtggttttagcaaccgttgattcttcccagaatcaattattactatgatggttataaaatggctattgtctggatatttctatcatttctgtatttgtcaatgttcttttgttaaaaaaaagagaaaaaaggagctttcacttctcaccccataactatctatctgatcttctttagctagctgtctagctacctgttaaacatattaatatggactcatgaattttttaatgaatgtattgtaataaattccctcagtacataccgtattgtcccaactttggtcagtggaagccctgtctagctgactcctgtgtccttttgaaattatcccttaaatgtttgagtacttcatgaattttagcacaaccagatattttagtctcactttgtatcttctttgccgtaggcttagaagaagccatttttctatggagacctagttcctctggagctgctatttaggaaggcatcagtagttttgtgaaagctccctagtcgatttcaatatgcagcaaagaataagagacatagattagagtcttccaaggggagaccacctgttcccacaaggtgtttcttttcttttaatcacctgttatttgtggtgctgatttgttgctgagatttagattttcatgtgtgttactcaagagatagctttaaatgcaggtccctggccccaaccccaaagagtgagttcagtagttctgccttgcattttaacagtctggtgcaggtggtccccaggccatacctgtagaaaatgccagaagtaaccctggaaactgggaattaggggtttcttttgattttcctcttttgctttttatcagtggtttctaccttgcaatatgatttcagaatactgccacgttccccaggtatgtggtaaggatctaattgattaatttgatggattctttgaaaatatcagatgatttaaacccttgtagctttactcttgttccatcatggggaattggggatgtgaaaaaaagaggtggtggggtgggggtggggtgggaagctttataagtgttggaagttttcagttgacccaaagacttttttcatccaatacattatttgttgttattagtttattttcacggacactgaatgaattggcctagtaaagttttcacatgctgtaagatcctaggatgtaggctctaaaatatagttgtgtgtgctgttttggggactgggtcatgacaccgtagtcagtttctgctatttccttttctgagaaggcaattaattgcattgcctccccatccaaccagctttattttattaaatctggggcctgtagggcccaagtgcccagcagctgtaaggaaaagctcctgatttgtggtttttcccttcctggttccacctttcaaacaaataccatgttagtgcagctagtcccttctgtgatctcaagacccaggactgagaatgcttaagaacagtcagatgtgggagggagatagtgcttctggagttgcgttgcctggtttgaaatcctctggtaaaatacatgatctctatgtgcctccgaggtcttcttgtctgtaaaaagggggttagtaatctaccccagaggttcagtgtgaggattaaatggggtggcatatgtaaagtgcttagcagtctatggcacatagtaggtgctcaataaatgttactattttattaaacagtaaatggtcacaaatggaagggggccgtggggtctagtgagagagttgagggtgtgctgtctcagttatcattagatcggctattgtggtatcatagtgcttgtgatcaacgaacccttatttcacttaatacagttgttcccccttacccgtgggtgctacatttcaagacccctagtggatgcctgaaaccatgaatagtgccaagtcctatatatactatgtctttccctatacgtacatatctatgagaaagattaatttataaattaagcgcaggaagagattaacaccaataaataataataaaacactaataataaaatacaacactaacaatatactataataaaagttatgggaatgtgttctctttctctttctcaaaatatcttattgtactgtacttagccttcttatgatggtgtgagatgataaaatgcctacatgatgtaatgcagcgaggtgaatgatgtgggcattgtgacgtagcgtttggctactattgaccttctgatgatctatgagaatgaggatcatctgttttgagtgatcctggatcgtggagtcacaacgctgtctgtggttagatgtgaggagcagacagtgtcagtgactcaggggcagggaacatccgtagcgtggagacgctggacaaatggatgattcacatcccggacaggatggagcaggatggcatgaggtttcatcacactactgagaatgacatgcaattgaaaagttatgaattgtttatttctggaatattccatttaatatttttggaccttaggtggccacaggtaactgaaactgcagaaagtggaactgttgataaggggggactactgtaaaaattccactcccagttcatttggacatgaaggtggtggctcaaactaaggaattccaaacctcaggcataggcaagtcataagtttttttcctttagtttatgtgagctattgaaatgaggtggcattgtcatctccttacctctttaaggaaggtcaagactcactagtaaacaccagtgaaattccaggagaggaaaaaaatgacaaatgactttcttagacttccttaagtttaagatggatggatgcaactgaaatacaatttctcccaacttcaagcatcccccttgaactgggttgtaggtcaggtggtactggcaaacaaattcaaatcagtgacaggctatagttgaggcctcgaaaagcagcattccaggagtttggtgttctctgtaatgagaggtccatggcagagacctaagtgacgtggtacagtgttgcaggaagaagttgagtacagattgcagagagtttggcacaaaatgtgaattgaattagtttatccagcactagagagagaactatgaacttaggctaaggaaatgctgccacttactagcttggtgacctggggtaagtcattgagtcctggattcctcatttgcaaaatgattgcccattctggcttttattttttaactcatgtggttggcaggaggagagggtgatggatatcagaagggtttgtgagctatcccagtgcgagggcgaatgattgtgcttggcatcaggtcacgtgatctttaccaccagccacctctgggtccctcccctgtgccctctgtagggcttactctttggcatgttggcagtgagctttgtaggactttatgctaccaaaacagtaacagtcatgaggctggactagcctggcagagagaaagtagcgaagacatcattcttctgacaccaggcaggcctttatggaagtccgatgcggggatttggtttaagagcagtctcattattctgtttcaggtcctacatccattgggttagtcttttctctaagaatagatcactctctcctttgccatttgtgcagtgttggattagatgctactttttacagagggttttttgaacatatgaacttacatacaactgtaagttttatggcttcagctaacactagatcttcagatggtgttattttaagtcactttggtcaggactttgacttctgtggttgtgagtgttggttttcagacgtttgtcatttcacttgtttcatgttcagatttgtgtctgcagagtttgcttttaacataacatccagcaaatgaaagccctttaaagattggtagtagaacttcattttaagaagcatctatggggccagtggagtcgcaggggtcaggagtgggatgccaagattgccttgtaatctagactttctttgctagaatgagaaatccatatcctttatggtacagggtacttgatttgccttccattgtatgggaagccatggtatagtggtggcgttctttgcatcggaatacccattcctcctgactttcctccttggaaaagcaagttggagtgggccctctgtcctagggagagccaagccctccttggggttgcactactcagcctgctgacagtgccatcagcatctaggaattgccctggaaatgctgtgtttgttcctaagacccagaggcttgtaattttgcacaaaggggtggagagtatttgtggagtcaccaaagatgtgattagacaagatatcgattctgaacttctgccctcttccttctattcaactctgttcttgcttagtgaggtacaggcaagaaaaatggaacagagagaactaggctgccggcttttgaaacatattgatcagggcacacatccgatgtagcacagagaccttcccctttatatgatgtcatcctgcattggggccttaatgtgccctgtgatcacctctgcatggacttcctttctcagagaaaagattagagaagaaaaagaatccctgtaggcagtgctaaaaaataatttaagcatttctaaatgtgtttctttgaagtcattgatccctttggttttctaggccatgcagtggcatgaaggaatggtgtgaggcggtcagccatgaacgacaaacttctgagcaatgtcggtctcacttcctacctcccatccacctccctggcttgggcctccactgctgtctgtctgtctgtctgtctgtctgtctgtctgtctgtctcaccctcacccccatacacgttctttctccacatagtgcacatctgtggtgtggatatgctgtggacagttgtgtctgtacttgaaccagctctaagccagggtctcccagataggacatgctgggtgagtgagatgttgtaaccctgagtgtcctctggttgagtgaagtgtggccctggctcttatcttgatttgtctggcttggttctgcgtaagtagctggggatcctgttaatggatcccctgggacagagggaagaggacagaagtagatttgttgaatcctgtgggggtgtttgaaatggtaccaagagcaggctgaaatctaatcagccttcacttatcaggcttgagttcccgtatgttgaaagggtgacgattagtaagaaaaaggccaggatactttatctttcctttgcacatttagaaaaatcccctctgccttgctagcattagaagcagaccattcttttttctctaccacatcacatcagcttccattaaaaatcaacagcagcaaatacaaagccccatctatggaaaaccgtttaaggcaacactgtgctccagtgcttcaggggtggggtatttgccttctgcaccaatggatcggtttctcatatccatgcctttctgacccagcagcttttaaaagaccaagaagcattgctctgctttctactgcctctctctaagagaccagggctgccgtgcctcaagccatgtcccagagagcatatttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttc

SEQ ID NO: 3220 - DNA, 209997 bp, human
ctcaccaacaaagctccagaaaagcccctgcacgaagtgcccagtggaaactctttgctgtcttctgaaacgattttaagaaccaataagagaggtatggaaaaggaaaaagaggttccctccctgcacacaaacaaaagctggaaacttctggtgaactgtgtcaaactttatattgctgaaaaattgaatagagtttgtccttttggtttttggtatatattttggatacacacatacatacttggcaagtgactatatgtatagtaactgtaataaagggaactaataaaaatattttttgacagtgggaaagtagactacatttgtaaatgatgatttttctggagctgtagatttcactttcatatctatttttatggatgaaaggtgaatttagagaatgctgtggtgcaggcctgagccgtgtgtctgaccgcactctccctttaatttaaggcaaaccttatcaagttatttctctctccaactgctaggctccctagcgcagaccctgcctctctgagtttgtgaggcagaatgtgcaaagatatagctaacacatctgtctgaccagaagacctttaacaatcttgttttctctcttttgagacctcaaggcagattttcaggtatcagcttgttggagttttgttttttctcccatcccctcttggtgataattgtttgaaataatgtgagagagaatagaagactgcagagacgaccccactcaattttatactgtgagcacactagggtccctccgtttttcctgaccttggaccagccagggcacatgctgagcatgcctgtaggttagcgcttggctgccagcttttagtgggcttattacttccttaaagagaaatagagagctgtttgaaagcaggcacaggaactagattagcaaagggttccattaaccagaaaaaaagaaggcaagtttatataaccatggggaggaagaacagctaatctttcataaaatttagacaggataagaatttgtccagtaaactgcccattgatcatagctttgtgcctctcttcctttctgtctcttcctctactgcctccagctgccctgggttacatttccctttttgaattattcagatcaaatattggctggaggcccatgttggttagcagctataggattttctttcttttctcgttttgttaaattcatcctaccaaagcaggggatttcccattttaagaattaagtgccctttgctgtaaaactacagtcttgcccaaaagtgcctcctgcattcttgcaagtaagctctcaaactcctgagacctgcattcattggatttggtgaggtagagttcagtgtgtgttctttctgcactttcaaaccaatgagaaggagccctcccattcctccacctgcctcttgggtccgcgggcacggcaattgcacgcatgttgaccagcggcaaggcctctttggccagccatggtttttgtcaagtcagtaagagatttaaagtaattaattaatttaacaagataaggaattaattaaggtaaggaattgaggtaactatttggatgagtttagtaaaattacctgagaactttaaatcaacgaaggaatagaatttttcagatgattatctcttcaccactgaaaatctggcctctgagttcccctatggaatttttcattcaccaaaaattggaatgcagagggatggcttactgccttacattccattttgaaagctttctgccttggacctgcagcctggttatggccaacctttcattctgaggcattttatatgtggaatctgccggtggttgtgggacctgagtacatggaggcattctgtaaatatgaagtctataacaaatcatcttcattctgtccgaggcttcaccctgacctcctgggtcacctgggcgtaacataaatttccagctgaagggaagcattgtgtaccaggcccagggctgcctctggccctcccccaccagtcaagactaccagtattctgctaccccttataataaacagcgggggtagattgattggccttgtcaggccagataaatagttcattgtactgagctcaaaagctacatttttttcccacccaaaatcaatgaaaaaaacacttttttccccccttaaaacaaggatcagaggctaaatctgtgggatgattctagttacttgtaaacacttcggtccaactaatttttaaagttttatgagttaccataagtgactgaaggggcctccttcccctttgtttccatcatcgagctttgtctccagcaacctttcggatgttttggtctattactgttgttgtggctattagggaaggaagttgctttcaggatttattaacagcctgctttgattggctaacatgggatcttagaggatatgagttgagtccaccttgtgattcagtcttggacccttgtaagaatttaatagaatgaacacaagttctcttccttgaacttgatcaaagatgagatgactgttttctgtatatggaccttatcatttgatacatgcttgaagttggattaataatgaaagattgacatctatttctatcatgagtctgaaactgaaccacttcattgggtcctgaacttgagatagtcctagctgaagaagtttgcccaattgtgtccagctgtttttgcgtcttgtgacatgcctcactttgcagcaactgcaaacaggtagtagtccctcacgttgtgggatgagctcaccctccccagacacctgcataaggtcagaagacatcttgggtttgaaggaagctattcatagccttgagaaaaagccagggctatggaaaccttagtttggggactgattagtttcacttttcagctttaacgtttgtaaacgtctgcagagttgatttagggggtactggaatgactccatgggctttttttttctttctttctttctttcttttttattttttggaaacagggtctcactctgacacccaggctctcactctgacatccaggctggagtgcagtggcgcgatcatggctcactgcagcctcgacctccccaggctcaggtgatcctcccacctcagcctcctgagtagctgggactacaaggtacgagctaccacacctggctaatttactgatttttcgtagagctggggttttgccatgttgcctagctagtcttgaacgcctgggctcaagcaagcctcctaccccagcctcccagagcactgggattacaggtataagccactgtgactggctggcttttcatttgagaagatgatgtgactggaattgagagagagaaagtacatcctcccagctgacttggcagccactggctacacattctggcattagaaccttaggggcacttgtgtctgcactcacttctggccatttctgtggtccttacctgagtcacagtgaaagagcttcctgtttaaaacaagcctttcctgaggaataagaagtcgtttttcatttaaacttgcagcatggatgttgtatgttctgaagttatcccagactccagtatatcgatgagttaagccagaaaatgtgaaaactttacttggagccaaatgtcattctcttgatgaaccagacagaaaagagttgtatgttttcttcaaagaatgattgattcttttgtttcttctatcattaaacccataaaagagaatgatgggccctcctaaattggagcattgatatatagagacttttttaaaaaagcattcaaatgccgagattgtgccactccagcctgggcaacaagagtgaaactccatctcaaaaaacaaacaaacaaacaaacaaaaaaaacgcattcaaatgttgagtttagaagaaaaattgaataaaacggaagtttgaacagttagcatatatcctaaataggttcttgaaaatgaacagtggatttttgtccatttgaatatagactcttacctacttgaattaaaaatgaaataaaaaaatcaagctggacacagtgactcattcctgtaatcccagcactctggaaggctgaggtgagaggattgcttgagtccaggagctcaagaccagcctgggcaacatagcaagaccccatctctaaaaaaaataaaacaattagctgggtgtggtggcatgcacctgtagtcttagctactcaagaggctgaggtgggagaatcacttaagcccagaaggtcggggctgcagtgagctgtgatagcgccactgcactccagcctgggtgccagagtgagaccctatctcaaaacaaaaaacaaaaaaaagaaaaaattatttgatccttagaaggatttcctggctaactttattcatgtgatcagttaagtatccaggctgtcatcaataccctgctggcccgtgtgaggaccaggttccatctcagggttctcgtttgcactgttaacagtgcatgcagagaagatgtatctctgcctctctctgaacctctcctgttgcctggaattttggacattgttccttcctcactttttggtagacacccatgaacattcaatagtacatgtttagtgcatgcccactatgcatctgcccttgtgcttggtgatggggcagataaagactggaaaaacaccagccagtcctgcctgcaagtaactcagtctgttgtatcccttgggaaacgttgagaaagtgctgcacgtttcttatatcattttgatggcaaggtggggatgtgtcttgtatttacttctgtcattctgaatgtgaagccactccgtgggtttctggttggctttatatgtccttgtttctatttccagtttatcatgaattcagtgtttggtaagtctctattgtattttgcacatttactattttttgctatattattatgctctcctgatacaaaatgtattttatagttacctttttaagtcgctctgctactttggcatctgccttcccaaagataaactgcttttaccatctttatttaaggttttttatgcatttgcattttactgccccttccagagattaatgctgaaagatctgacggtttaaaagatgttatttgtaacaggtctagctctgatgctacgaggtgagatcgtctgtctcatgagattcaagttaagatgggggagggttgctctctgaattgatatgtgggtatgactgattgtagaacattgctctgtgggttcatttctggtgtgtttaatccttcagacgggttccattcaaaagttttccttaacagagggatcaacggctgctcttcctctggtgacacactgttgctttaaaagttagtgcagaagttcttccacattaatatggacctcgtgtttgccacatggaagggctctccagtttggtctgctacctgtagctgtcagaagaatgttgcttaatgtttacctttcttctcatagtttcagcactggtcattccaagccctaaacagatctaagtgactgcccgtcctttccccacttcccctgaaggggaaacgttttttctagcttttagtgtgagggcctggaatgcttctcatggcgccaaggcggtggcgtggatcttgataggccgtgagctctttggcagaaatgaaactgttaacaaaggatggaaagaagtatgtccttagtaaagaaaatgtcaacctctttggtttgccagtggtttgttgtttaaggtaaatgtgagatctgggggtttgtttgtagagatgagactttgtttctttcaaattttctattggagaaataaatgtgaattcttgccagttaactgggaatctgaaaatgtgccatttggggtcagacttttctttgagtttcaagattgcctgtttatttgacttaaggagctggtgtttatggacagatagaataagagttaacagaagacattactgttgtgtagaagctcttggctatcacctgagctggtctttcccaggggaaatgaaaatctggcgatctggcagtgaatggggatagatatgatacatagtcattcagtaatatatacgtctgtgtgaatgtatctgtatacgcatctatagtcttattttccagtgggccttcattctcaaaagctctggagtcaagagcctttaaagaagtcttttaaactaactgatccctgactgcatttctggcaagttttattgggacactgcgttgttagcaccagcaattgatgttggagtgtgtgttaccctttttcatgttattttctgaacctattgagcctagagtgaggggtggtgaaatgcatggtaagaactacataggagggtatagccatcatgttgcgattatgtgtgggtcattgataaaatcggtttttagatttttttttctgttatgtttaatctcctttctatctctgtgtcttctgatttcaaggcattaacactaatgagtctcccatgggttagtcatgggtttaagactcccgccatactcctgctggtgtccgcccaaatccacccagaggacaagccatgaagtgggtttgtggtggtggctccacctggtggctctcctaggaaactcctctttctgcccaccttttccttctccttgggagaatcttgatggaggatgcctttgattcctctgactcagtgttcactatttgtgcagttccatcccagacccacggcttctcacattacttatggatttttttagcccttttgctttttcgcctaagaattgctctttgaactcatataatctgtgtcctgatccttgttctatctgtgatacccctatggaccaggattattgttaatgaggattaaaaaaaaaaaaggactcccataggcatgactctagatatagatattaatttggacaaaataaagaatcacactgaaatccctgtaggtatgtatgccaaaatctcctgcctaatagctccaagtacccttatctacttcttcttcactttttgttgaacccatttttcctcaaaggagcaatattttattaccaatgttgttttcaattgtcagcaggtggcgaaagtaaaaagccaactaactttttggcttcattgttgtttcattattgtttgtgaattctctacaggcagcccccttcttgcctgggcacagactgcccccgcttggtatgtcactgagcataagtatttttgataaataaaaatgtcttttattctcattatttttcagtttttagttgttgataatattgcagatatgacttattttagctgcattgtgggtcagtctgggaacttaatcaccatttataactttgcttctatgggaataatgcattcagagttccaaactctctgcataaggcacatataagtctttttttttttttttttttttttttcttggaggcagagtctcgctctatcccctaggctggagtacagtggcatgatctcggctcactgcaactttcgcctcccgggttcaagccattctcctgcctcagcctcctgagtagctgggactacaggcacctgccaccatgcccggccaatttttgtatttttagtagagacgggatttcgccatgttggtcaggctggtcttgaactcctgacctcaagtcatcccccagcctcggcctcccaaagtgctgggattacaggcgtgagccactgtgcctggccaagtctgacttcttttttttttttttttttttttgcattgctgacatgaatccttaagtacctttgtaaaagtcagagtccgtataatcggtgcccactgaagtttgctcatgttgcagaggagtttataattcacacagtatagaatgctggaactgtgcaagctccacacagtacactaggctctgaggatagctttgggttcaatcacattgcaccattgtatatggtgcttattttcacaaggcctgagttggatcttagtgtgcccacgtttgtatgaggcatgtcgtgaaagtgggtcctattgtatatttccatctactagtgacgagaccttgcaccaagcgtgacatgctcagatagaaaccagcccagcatttctcagtgtgtgttgtatggaattatagcccttctgactattccacaaaggagggatgcggggagagacaggcagacaagcggggagagaaaattgcctctctcgtcaaatttcagctgcagcactaacaccatcttggagactgacaagcacattagcatagtacaggctctcagatggcctatggtaaggagacctgcttatctttgatcatggaactgcatgttattggatactagttaagactccactttgggatatgttgggctttaagatacaggacaaggagctctgtaagcatccccaagataatcttcaggttccacctctcatgggaaatgtttgagtaagtgagtggagatggtggtgctggcactcagagaaatgactggcgaggcttcttaagcctgcgctgtcaaaaaacatgagttagatgatgctaggagaacattctttgaatctgaaacttgaaagccagtcctcttggtagtttttcaagtgacaagctgaaagggaattttccctctgatcatttcttgggtccttgtatctaagaatgaggcttagacacatgagtggaagtcctagtctgggctttggcatgaaaagcaggctgaggggacccaacctagcaactggtgaggccagggtgttcaggtctacctgggacttggatcacgatggaacctgcgattccagaggtggtttttattatgatgacagtctctacatagtcaacatagtctcattgccttctctacttgctttgactgaaagacagaagtcttagcttttcccgatgccattaaaacactgaacgtttataaagaagagccttcttctctccctactagtgaaacaggctggcatttgagttcaagtaataaatccacatgtggggttgtgaggaaaaaccacatagcctgcctttttagaattctggaatcacagagttacagaggttacagagggacccacttattgacatcccaggcgaacgaacatggagcctctgcccagggaattgaaaaggacactccttggctctggccttggctaagccccacgtgggagcctcctttccaaagggaagtttttctgggtagggaactgctagattaatgaaaggtaatcaggccaggtgtgatgacttacacctgtaatcccaacactttgggagggcaaagctggaggatctcttaagcccaggagttcaagaccagccggggcaacatggtgagatgttttatagtctctataaaaaatacaaaaattagccgggcatggcagcgtgtgcatgtagtcccagccacttgggaggctgaggtgggaggattgtctgagcctcggaagtgaaggttgcagtgagctgaaatcgcaccactgcactccagcctgggtgacagagcgagaacccgtctcaaaaaaaaaaaaaaaaaagtaattagaggtagatgatatttaggtgctggttgcatttgttgcattatatggggacagcagctatattcacttgcagtaagctctggaaaaggggcattttcttctaattatatctgttgatctgtcatcacagcctggtctctctgatgccatgtgcagcctcagcttagtctttggattcttggctttttgtgcttctgaagccttaagactgttgtacccaaacaatgaggacatttcatggcccacctccctaactcatgattaggccaacagcgggcccagctgcagtgccaggtgggctgccctcattgtttcaaccaggaagggaaagagagaccagccagaagcttcctctgcatgtgcctgtgcatgaaaaagagcatttgaggaggactagcctgcttgtcgcatttgtgtttctctggagacctgaataggttcagtggcagcaggaccttattgcagggaggatggctgttgggaggacccagaccactcctgctgcacctccacagcttctgcagcactttagacaagttgcagattccccctgtgtttccaggtttcccatttgtaaaacaaggaaatgctcttgttaattccttcagggcaattgtgaagattaaaaatgagtaaagaaaataggttttgggatagggaggcaatagagtgaagtggggtagggtgtcactcactgaatacagtagtaattgctattaaaagtagtaaactgctagtaagaccccagagcattgggaaggaattagagatttatggaaaataataaaacgtgttttcatgaaacaacctgtgatcacatgcacatggcaccttctccaggatggaccatatgctaggctgtaaaagaagtctcagtggccaggtgcggtggctcacgcctataattccagcactttgggaggccgaggcgggtggatcacaaggtcaggagattgagaccatcctggctaacacagtgaaaccccgtctttattaaaaacacaaaaaaattagccggtcatggtggcgggctcccgtagtcccagctacttgaaagtctgaggcaggagaatggcgtgaacccgggaggcggagcttgcagtgagccgagatcgcgccgctgcactccagcctgggcaactgagcaagaatccgtcccccccaccccccccccccgccaaaaaaaaggagtctcagtaaatttagaaggattaaaatcatacgaagtatattctccaatcacaatggaattaaattagaaatcaacaatagaaggaaattggggaaattcacaattacatagaaattaagcagtatgctcctaaataaccaatgagccaaagaagaattcacaagggaaattttaaaatactttgaaattaatgaaaatgaaaacatgacatacaaaaatgtactgcctgtggctaaagcagtgtttcaagtgaaactgacagctgcaaatgcctatgtacaaaaagaagacagatctcaaattaatagcctttctactttctactttaagaaactagaaaagaaaagcaagctaaactcaaagcaagcagaaagaaggaaatgataaaggttacagtggaaataaatgaaatagagaatcgaaaaactatagaaaatcaatgaaacaaatagttgatccttagaaatgatcaacaaacttgataaaccttatctacactgatcaagaaaaaaggagagaagatttcagttactatatgaggagttaaagcgcgaacatcactaccaatcttaagagaaattaaaaggattgtaagggaatagtatgaacaactcacccactgctggtggaaatgtaaaatggtacagccactttggagaacagtcacccatatgacccagtattccagactctagaaaaatgaaaacatatatgtccacacataactgtacatgaatgttcatagcagcattattcataatagccaaacagtggcaacaacccaaatgtccaccagtggatgaatggctgaacaaaatgtggtctatacacaaaatggagtatcgtaagaaggaatgaagtcctcatatatggatgaaccttgaaaacattatgctaagtgaaagaagccagtcacaaaagaccgcatattgtatgattccattgatatgaacgtgcggaataagcaaatccctagagatagaaagtagattagtgtttgcctaaagctgaaggtgggaatggaaagtgatttttggtgggcgtgaagtttctttttggggtgatagaaatgttctaaaattacactgctgtcatggctgtacaatcctgcagatacataaatccatttaattgtacacttgaaatgggtaaattttatggtatgtaaattatatctcaataaagctattaaaaaatacaacacaaattggggttaaaatgctatgtctgtctgtctgcctctttctcttttatgtcccctaccactaacctccttcccacagctgagggacaagatgtgtcattccatttattcaagtctttaaaattatatatttctcagcaaagctttatatttttctttattcaatcagttgcctaggagatagtaggtctgagggatcaaaaagacactgttttgctaagggtgacccaaatattagataatcgatttgagaagggtagagaactggctgtggcatcctattgttcatttcttgagaaaaaaatgagattctctgtaaatcaaaagccaaacctcttatattctaaattctgtgcttcgtagaaagagcctctgctagaaaggaaagaatccatttatgtttccagtttttcttgccgttgtcagtaactgcgttggctatttttgctcataaatctttatccacagctctgatgatttctttaggaaagatttctcagatgtggaattactggacaaaagtgtgtgtatattttatggtacttggattcattatcaaattgacttcctgaaagcttgcactgatctgtctcactactgaagtggggagagtgctgcttagtgttctaagcttgaatttctcagattaatcgagtgcttgaacattttttcttccgtcatttgttaataatctttgcactttatattgaggtccttatttttttttttactggttggtgtactattcctttgtcattcatggcaaattttgcttcccaatttgtttgcttttcattttgtttacgattgattttgatgcacagaaatagtaaatttttatgtagattggtatattgatgctttcttttgtgatttctctgaataaattatcacctagcttatctcctttttttatactggcttcattttttacttcaaaattttaatctgtatagaattttgatgtgtagtatgaggttagtatacaaattgatttttattttgaaatagccacttttccaggaccatttattgaatagccctttccagtgattgtatgatacctcatttatcatataatattattatatatatgaaagtctttgggctttcaattctataccattaatttgttttaccattcttaatatggttaactattatggctttataatatattttaatatattgtatggcaagctttcagccttcctatcacccttcattttcaaaaaggatttagttactctcatttattttaaaatcatgtcatcaagttaaaattttaatttcattcaaattataagtcacttttagaagaattaacatttttctaacatttttgtttaaagctttgcattgttgcataaaccaactttatatacaagtatataagtgaaaaccttttctcccccacctctcctccccaaacatcacagtaggctaattcttgtaaattaaaacatctatccccttctgaattctaaacagcttattctagtcagccagtgacatgggatgtcactctgttgagtcaagtgttacagttttatttgtgcagtcttgcttgttgatgacgttattcccagatagatagtggttattgttggcttttgtaaataggatctttcccctcatattttttgtattgctggtacgtagaggaatttaacttttgaagatttctttacaatagcccttgtggaacactcttgctaattaaaaaaagttcctcttttatatttagaaaattattagtacctatcagtcactagttttcagaaggtggataagtggaaattataaaatgctgtatttgaacaaatgatattttagaaacaaaaattccttggcttggatagaacgctgtgtgtgtgtgtgtgtgtgtgtgtgtgtgtgtgtgtgtgtagggatttttatccaaattaaggaattttatatatacagttgacccttgaacaacacagctttgaactgcacaggtccacttatatgtagatttttttcagccaaatgcagatagataatacagcatttgtgggatgccaaacctgtgtatacagagggccgatttttcccgtgcttgagttccacagagccaattgcgagacttaaggatgtgtggattttgggatgcgctaagggtcctggaaccaatctgccgggaatactgagggatgattatatatgtatatatatgcagctgttaacagtgttatattgtatatttcaaaataaacagaagattttgaagttttcactacaaagaaatgataaatatttgaggcgatggataagctaaatacccttacatgatcattatacaatgtatacatggatcataacatcacactctaccccataaatatgtacaattattatgcgtcaattgaaaagaaaacttaaaaaagtggacatgtgcaaacctcaaaaaaaatcaaaagctaactttcattagttcatattatgaaaacaactgtttttgtttggtttttcaactatgacagtatattaaatgaaaaaaggaaaaccttagtcatctgatcttaatgatttgtaatctgatcttagtgatctgatcttaaatgaatttttttatatatttggggctgcatttcattctattaatgcatttttattcttccgcaagtgttgtgcatgtttaggtttttattttctttactagattataaggcgcttgaaggaaagaaaccacatcttattcatcttggagctcactttaattgttgaatgaagtatatgcttgtactcatataccctaatccttttgaaaaacaagttacttcaaggcaaactaccagagggagaactaacttattaagttacatggttaaggggaagctgttgaaattctgtgattcagagaaattgtctttggtttctgagtaccgagggagagaggagacttattaaacatctgttttaagagtggatcctagaataagtactaaacctaggtcttggcctgaccacaggcagtttactagagagagagaaggtgaaatagtttcagaggaggaaattgcaactagatcttgagtaatgagattgaaggtggagctaagttagaagggtaacactgtgctcaaagagaagggtcctaaaattttcacattcacttgtgtaacatgcgatggcgagtgcgagaatgtatacaagacaagggaaggtttcaatttcatgtgaacattttaatctatatttgattttacccttttgcccaaggttttataaatgaaagtgtaggccgggcgcagtggctcacgcctgtaatcccagcactttgggaggccgaggcgggcggattacctgaggtcaggagttcgagatcagcctgggcaacatggtgaaaccccgtctctactagaaatacaaaattagccgggcgtggtgacacatgcctgtaatcccagctactcgggaggctgaggcaggagaatcgcttgaacctgggaggcggagggtgcagtgagctgagattgcgccattgcactccagcctgggcaaccagagtaaatctccgtctcaccaaaaaaataaacaaataaataaaataaaataaaataaatgaaagtgtatagagttcagtttattttctatatagatgtgtactcttccctttttgttggagtacatgggccagacctagcttttccttcatttctgggcttttccttctctgatatttgattcctcatcactttcatcaggaccagggagggaaagttaattttggactatgtgattatgcatcagttttgcctgtcaggaacctagtattatgaatgattaatgattagtattgttctaagatttcaatttaggtaaaatttatctctctaaccacctgcagcttgcttgttgaagattctgtaacactagagcagggaggtgacaatccctgtgggggtggcctgagaagctcttttctcccctcccacccttagtctcttcttgcttctttttcctctctgcccccttcttttctccctagggcccacttggatggattctttggtattgtcattccttacaaaggaaaataaaaattcccagatagtttgccactgagttttccctttaattattttacccctttgctagcccacattatttgagagattaaagcaaacaaatgaacacagcgtgctgcttaatagttatttcttttatggaaatagagttctgctatgttgcccaggctggtcttaaactcctagcctctagtgattctcccaacttggctgctcaaagtgcttaatagttattttttttaaatattgtttagggaaaaaatgataccagttgttttatatttgaccttttttaaaaaaaagctttaaagcagctctttgataatatcactagaagtagtttatttctttttgaagaaattagcttcctttgtaatttacttttgactacatcattgagataaaaggtaaggcagttgaaactatgtacaaaaaggaaaaaaaaaatcgctcagttactgatgggtctggcactgtgtggttagggatgggaaaaccagcatacactagaaatgaaaatcctgtttctatttcatacgtatacatatactttaaaaactttacatgttccctcctaagctttggccctgtagctcttgcccttcttgcacagaactcatgtgcaattcacattaatgttgaagagactcctttcctccctccttctctcccttcttccttctttcctctgttcctttcttcctctgactctctctccatccttctcttccatactttctaaggaccatcccattctggagtgggcccttagggtgtgggtatatttaagtgtgtgtcattagctcttagttaccttttcacagagttgatgggaataaaatggaccattgaaatccaggaatgacccacagaaatgcttttgcagtttaactctaaacctttttattagaaaggcttatataggatgtgatttcacttttctcacttcctgctgatcctctcaggtggaggtgatcataaatttaaaaatgaccaaacctaggcagcaagaaggaagagaggtaagcatcagctggggattttgtaggatcagtctctctccttccacatgttcataaattatgaactgtatcgatccattcacattgatgtatgaactcattctgccaaaagcccaagttgaagtggaaaatggaaagtgatcatttattagagctgatgagtgtcagctttgtactgaaacaaagaaaacgaaaccacacaggcctggacggcctccccttcaaccctaagattctgtggccagaggcaagtgggcctgggggtaaccagcaagacttagtaacagtttacaaatatcctgcctgttttcagtggcttggaatcagactgttatctccttgaggctggaaaagcatttctgtgcctttatctccccatgacttctgcccaggatgattcagacaccctcactggaattatcttcatctgaataattctcagctctatcagccattatcaatgttgggaaggttatttcacctttttaagcatcgatttcttcatctgcaagttgaaaggttgagaagtttctagtatgtcttcagctgggcatggtttctaaaagcttttgttcctatcttcatcagaacataactagttctccagttcagggtcatggtactgtttatatagagtcctcaaagcattttaacctgtgagccctcatttggttattaagcttttggaaatgttgaaaagcttaagcatcccacttctctctttgcaaaccctccccaacgttcccaggaagaaatattggggtccagtctgtgtaccatcagcccattctagctcctacagctgacaaacatttgttgaacaaatcaagttcccacatgaccagtcagaagcctctggagagcttcaaagaattctttgctgagaatgccccatggtgattttgttgagtaatgaagttaaaataatgtttctgtctttggtaaaccacccattctcacctactgcatggcagcatgggtttctgccagtctttactcagcttgattgcacaaggttgggcaggtggtgagatgtgtattcactttgccttcagctcagcatgcttcagaatacaggtttagcatcccaaatgtgaaaatccaaaatctgaaatgctccaaaatctgaaactttttatgtgctgacgtgacgtttaaagaaaatgctcattggagcattttggatatcagattacagatactcaactggcaagtataatgcaaatattccaaaacatgaaaaaaaaatctgaaatccaagacacttctggtcccaagcttttctgatgagggatattcaacctgaactgcctcttccaaaggcttttgcatatcatctccatatttatttcagtgggtgtgggatagaatcacaaattctagctgccagttccttctcctcaacctgttagatgatagctaaagattgctagctaagtgatacttttttatttgagatggtgtctcgctctgtttccaggctggagtgcagtggtgtgatctcggctcactgcaaccgggttcaagtgattctcctgcttcagcctcctgagtagctgggacttacagtcacgttccaccgcgcccagcacgtttttgtatttttagtagatactgggtttcaccatgttggccaagatagtctcaatctcttgaccttgtgatctgcctgcctcggcctcccaaaatgctgggattacaggcatgagccaccacgcccggcctaagtgatattttttaaagcatgtttaatatttcaaaatgaggttttaacagagacacatagaaagggatcaacaagggacttgaacaaatatttgcacacccacattcagagcagcattattcgcaataggcaaaaggtggaagcaacccaagtgttcattgaggatgaattgataaacaaatattatccagccttaaaaaggaaagaaattatgacacatgctgtaacatggatgaactttgaggacattatgctaagtgaaataaaccagacacaaacagacaaatactatatgattccacttatgtgaggtacctagagtagtcaaatgtatagagacagaaagtaggatggtggtttgcaggggctgagggagggataatgggcagttattgtttcataggtatataatttcagttttgcaaaatgaaaagacttctggagatggatgttggcgatagttgcacaacaatgtgagtgtacttaatgccactgaactgtacacttaaaatggttaagatggtaaattttatgttatgaatgctttaccacaataaaaaaggatcaagaataacatgacaaatacccaacacccttctacccactaccagctaagaaattctatcaattagcaattacagttgatctgtcatgtatgttaccttgtctcagttgcattgtgtgtgtttcttgagaagcgtgatggatgacttgggtaagagaattctgggtcaagagagcattccttctcctgttttcttttcatttttatttgttagttaaagataaacatagtacaataagtaaaaaattaataacctttctctgtcctttaaaattagtgttcctaactctaaaaagcaatgtttctagaaacttctgtttaccctttgggctctgatgaatgtggagaaaagagagagaacacttaactcaccaggatggaagaataagataaaatatttgcaacctccttcctccctgaatgttgtgttaaacgtttttttgaggacttgcgctgtgtcaagtgttgtcgtatcagttatctattgctacaatattgctgcataacaaattactacaaaaccccagcagcatacaacattaagctgctctgtgtatcttgcttgcattatgtgtacaacaaacccctatgacatgagtttacctatataacctgcacaatgtacccctgaacctaaaataaaagttaaaaaaaaaaagaattaggaccttaatgcaatcagtacgccctagttacctatgcaaatgttgtagtggagacatctatgcagtcctttaaacaaccctgagaagtaggtggcattggcctcattttgcagttggaaaaagcaaggctcagagaggttataagacctatccaaggccacactgttagtgagtggtgtagtttgggtttgaacctgggtctgtcagacgccttcctccatgccgcctctgccaaactccatgcagcaccttggattaccacctatggaaacattctgttttgccttttgtgcttctatttgcccctcccactcccgctctactcctttctctattatatttgattgagtcctcttctccaacttctgaagtgtaagctgtttctatagtcctgtctttggcatcttcctgggttcagctaatgccatgaagcatacgattccctaagcccaacctctaggctggccctccctccttgctgccttcatgtccactctcagacactctgtgctggctactggtttctgggctgcaagtcataggcaacgtggttccatctggcgtaggtcatgaggaaatacctgtcttgtgtaacaggaagttgtacacacacagggcaggcttgtcagggcccaggtttcttttctgtgccctgcctctcctggagttggctttgtgctgtgaccagcaagtggagcaacagtggacttcccagtttacatccagtggggaagtgcaggggacctctcttcatttagatgctctgggcagacccacctttgtctctcactgtaccaccctgacctaggactgcctgcccatccctgaacctatttctggtgggagctgacccacgtctggtggtctgtggtggagtggcagatgggagacagtcactgtgtccccaactgtccctatgtggttgagcagcagattctctctcctgtcagactcctgttgcttctgtattctgcattttatttgtttttatttatttttttgagacagggtctcactctgtcactgaggttggagtgcagtagcggaatcatggctcactgcagcctccacctccagggctcaagcaatccttctacctcagcctacccgagtagctgggactacaggtgtgtgccaccatacctggctaatttatctattttttttttttttttttttagagtagagacagggtcttgctatgttgcccaggctgggttcaaactcctggtctcaagcaatctgcctgcctcaacctcccaaagtgctgggattacaggtgtaagccaccgtgctcagctgtgttctgcattttagttggtggcattaccaaccttcacttcctcccatcgacactttggggtcatttttaattcttctttcttcttcatccccttatttacttacatgttttgttctaactttgtttatgagatggttgttaaaggtctgttctgggctagcctgtagtaatccccaaggaggccagctgagttcctgttcacagagtctaggatttgagaatcaaacaatccccaggcagcgtgggcagggtaaagagaacattatacactgggtgctgtgctctctcatggttgttattggtggtggtggttgcaggggaccataaccctgcctcaaaagcagtcagggaaggtgtctgggagggggtcacatgtaagctgatgattcaaccttagccatgtctcttgttcttcctttttaaaaaaatattccctggtttctgatttggactcttaacacttcttcctataaaccagaagtcagcaaacgatggcccatgggccaaacctggcactggctgtttttgtaagtcaagttttattggcacacaggcacacccattcatttatgtgtggtctatggttgttttcaccactacaatggcagagttgagtagttgctacagaggccatatggctcacaaagcctgaaacattgactctctggccctttacagtaatagtttgctgatctctgcggcagaccattagaaaaaccgaattcctgcctgccgggaagtttcgtcttgcaaaaagagatatacgtaatatatagaaaattttataataaagccctttgaggtaaagacaattaagtgctgaatacaatatttaaatgctgacaaaaattattgttggggagattaatgtggatttatttttccctactttctctatttttctctgctctttctctattctgcaaatgaatcttcattcattttttttcgcctcaggatttttagactgacactttctagatttataacttctaagtttacacttttcatgacactcactttctgccctctgagagggggaggaaaggtatggatcagtttggaaaatgaagtctgggtgagatataaccccctcttttaaaaaaatacacctttgcacctttcctgtatttacaaggaaagtgggatttgtttaaataaagagaaaagtctttatctgcttcgaataaatagataggacgtgcattactaacctgtttgtttggtggggtcggcgggggacatctgcttaataatctgcccttttctggatgatgcttattccccaccccaccaagaggggactgatttgttgtttttctgatccccacacaatcatctgctcagtagggcagcttttgtgctattgggttgtttacacctctctgctcttttaaaacattttctagtttgaccttttcttttagactcatcctaacttttcttagacttactataaaaataatacatgtttagtgtaaaaaattaacagagtcaagtcatggtgtaaagagtcacatcaaatcccttccctgagtcatacttcctggaagagacttggttcatggtcatccctacagatctctgtgtagatattaggaggaaccataagcagatgcagatagtcatttgatcataaagatgtcaatttcaaacacatagtggtacatacatcttggcattttttaaaaacacagatgggatcatactgttcaggctatattgcaatttttgtattaagttgacgagaatcttggaaatcttgccgtatcagttcatttagagctatgcttctctttgctagtttgtgtggagatacacctatggcttaattaaccagttccctgattgaaggacgtttaggataattctggtttttcactattctgactaatgtagcagtggacattatgcatatatctttgtacatttcatgtgagttatctggagtataacttcctgaaagtggaattggtgttttcttgactcttttacttttaacacttttttttttttttttttttttgagacggagtctcattctgtcactcaggctgaagtgcagtggcgtgatcttggctcactgcagcctcaacttcccaagctcaggtaatccacctcagcctcccaggtaactgggattacaggcgtgtgtcactacgcctggctaattttgttttgttttgttttgttttttgtggagatggggttttgccatgttgcccaggctagtctcgaactcctgagctcaagagatctgcctgccttggcctcccaaagtgctgggattacaggcatgagccagcatgcctggttgagacattttttttagacttcttttttttttttgaagaactggtcagatgcctctggtcccagctggccatgctgaccatagggtccttcatcctctagtgataccacagaaatggacctcagtggaagtcaggcaatccctccaggcagatcctgtgcaattataaacattagcatcaacttccctccttctatggaatatttctgtgcttgcagcccggcaggcactggggacggacacacacacacacacacacacacacacacacacacacacacacaccagtgcgcacgcgcacacacacacacacacacacacaccagtgcagctgagtagggctgggagcaaggggtgtgtatgaagccgtgtgggtacatggaagccctagtgacctctttatacccgaaggatagggggaaacttgtagtgctttccagaatttaagtagtcagaaaagggagagaaaagtagggctgagttgggggagggtaatgaggctgtggcaggtgtcagcctgcaaattagctgtgctggcctccctggaagaaatcatgggcattgagctcagccaagccagggcaccagatgacagagtggggctctcgccagccactgacccaagtaataagagggcacttggcaagcagcttcatgagcaccgtgccacgtggccatttgtggttcaggacttgcgaagttgcccaaagtggctcttttgttatgatgtgttactccaaagcttatgaagcattccaatgaacagagtccaaatgttatgtttactgctttgttaaatataaatagtttacccttgtacctttgggtttccttggaaactgtaatttttttaaagataggttcttgctctgttgcccaggctggagtgcagtggtgcagtcatggctcactgcaacctagaactcatgggctcaagtggtcctcccatctcagcttcccgggtagctgagactacaggcacacatcaccatgctctgttaaatttttttatttttattttttgtagagacaggttctcgccacgttgctcaggccttgaaattctgccctcaagggatccttccaccttgacctcccatagtgctggaattataggtgtgagccgctgcacccagcctggaaattacaatcttgaaagcagggattgggggttctttttatttaaaaaatttccatggaacctgtttgccagtctggtgaagcctgtggaccccttttcagaataatgttggtaaatgaataaaaagggaaccaaagaattacaaaggaaaccaattatgttaaaatagttgtcaaaatagtacaaaaatacaagcaagacatatgctttattatagcaacatccagcagtgggtcaggaggtgatcataattttgaagcaggggtgagtgtaaatgatagttcaagataactgcaactgtgaaatgaaatgaaaatatctattcatgtagtgggaaataaataaatttcatagatgctgctagtaccattgtggtttgttgcttagattcacggtgagaataaaggccaaatttcagaagatagtaaaagatgtatttttcttcccatgtaagtttagaccccctgaattctatccacacaccccagttaaggacctctgcttaaggggtttagcctttcagattatgaggaatgaattgcagggatataaactcccatttgcatcaagaaaattcagaaatacctaggcttcctcccctctttattctgatggggatgagaagggaaactatattaaaaatgagtcaaaatttaaaaatattatgactacctgcaatgaagatctccccctacccccaaaagagagggtacatgtggaattctttgacactttctaaatctccgagcacagtggccatttttggtactgattttaaaaactgggaaaccctagatttgtttatggtgtgtatctcccacccccacaacccacacacacatacctcccagtaattctctaagattaggcaagacagaagtatcccagatgaaggtctttaggattttctagacctttgttacagttcttcaaatgtttgtgtctttttttctcctctcctacccctcattccctcatcttttccccctccctgcccattctacctttaactgtaaaagttaggtgtctgatatattcatttgtcagcagcaaagtttgagaatgcctttaaaaatagatatgttagagggagtatgttggatagaaaggagaaatcttgtttatgctcaataaataacttacatttagaaccttccttcaatttttcctttgaaattctgtattctcatttcacttgaatgactctgcatggagcgtttaaaagtagatcaaacaaaaccctataaatatgttgagttcttttgggcattttgccaaaattagccttgcagggaaaagcagtgtgctttacgtattggattttctcctctgaaaatccagactccctctcctctggagagctagctgccagggctgggggaaagtcaagccagggacacattagggaagtgtccctggtatggcctgctgaggttgggttatttggattgagggttgtgctgaaaggccaaaaccaatgcctgggaccagcctgaagaaagatgaaaagcagagggacgtttagagacgtcactgattttatgttatgacgtgattcctttatctcactctgattggaagggaaggctggtgaaaaaaacattaacagagctgtcttttaacagattcctgaatgtaaagccaaatggaaaaaagggagagagtcaggtggaagtaagccccttggaaagtaggtctgtctccatcatcccaattttatacgtgagaaaaccgaggcagagagccacgcaggggttgcaatgctgggtgagttgggccgtttgtctcttctgtattgttaactcagggttctctattattattattattattgttattattattattattattattattattagttagaggtggggtctcactatgttgcccaagctggtcttgaactcctgggctcaagtgatcctcctgcctcagcctcccaaagtgctaggattacaggtgtgagccaccatgcctggccccagggttctcttttatgtgctttaatgctttaagtgaagaccacgtatccatgagcagtgaaatcagagcccctgcaccctttcacatggctaattcacatatcatttttataagatatagttgaggtggaggatgttgagttcttcatgctcatggcaccaaaattacagatgtggcttctaaagaaatatcagatgacaatgttaatgttaaaatatacatatacagctcctctttgcagaaactcagtttattcaatggatggcccctttgactattacgttggaagtagaaacttgatttgggggggtcagatgttaattgcccaaatttaagacagttttcagtgacttctttaaatgaggcattagactctgaagttcatagggctgaggagggcctggatcggggattttctagatatatggcacctggggtccacatagggatctagagtggtgcagtggcatcgccctaaccatcatgaggcagatgtgagtgagtcgaattggttgatacagatgtgcgtgaaagagctgagaggtgtcagggttgaaaagatggagacagacagcaaccgacactcacagataacaaaaacacaatggaaggaggacagtgctagagaaaagcaatggttgttaggagaacccagagaaggggcccccacggctgaatgaatgagtatgtatgtgtgtgtgtatgtatgtgttcccatgagtgaggggcgagctcggaagatggacaccacagggcccctccacctagtgagagatggctgtctgggctgtgtaggctggtggtgtctggccagggaagataaccttggcttggtcactgatggaatagtatgggcctcctcagggttctgtaacagcatctgatcagaataatgactaatgtgggctacagatgtggagccctgtctctgagctcacacctcctgctgtgttcgtagaccagccacaaccagttgtcattgggaggtccgaggccccttgtcattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtgatgtttttaaaaagtgattacagtatattacgtgctctttgtgaagacaaattgatattgtagaagcatttaaatgagtttctacccttcccccaatctgcctcccctgaagtatcactgttactttggggtatagccttccataccattttctgtgcttacacaagtgtgtccgtgtacatataccccctttctctcattcatttgtatctttttttgagacagtctcttactctgttgccctcattcatttaattgtattagaccttcataaattagttgaatgttgaatggattcatttatttattaatgaacatttgttgaatgtatactctgtgctaggttccgagttatcaggagtaactaaaatgctacatgctgcttagagttatgagtgtgtgtgtgtgtgtgtgtgtgtgtgtgtgtgtgtgtgtatttataaaattgggatcatagtatacatattacgtgatttagtcttttagtgtactatggacaccttttcacactgatacacgtagagctacttgttatatttaatggctgctggatataccttcccctcccagtagacatccaggtttcacatgtagatctctgtgcatatatgcatttgctattagaaacaatgctgccctgaaccttcttatacatatatctttgcctacttaaaccaaatgttttctgtcttttaaggggaccgaatataaaatcaaacatacgtcatttcttgttcatatatagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactagttctacattttctcttatatcctgccaagacttgggagaaaatgagcactggcatagctatacccacttgtcagatgccctctgcctttgaagtagcaggcaaatggatttcctgtgttctgcggtgcagagatgttgattatacacatccctgtgaaaatcaagcaggctcatctccagggaccacacaatgctggttaattaaatattatacatttccactgcaacagtccaggtacagccaagaggggtttgtaaagaaacacccacagggtccttttatttggagtgccattggcttctgaagtgtcctcctcttcctgtgagttgcattatgttgaaacaggatgacgagtggaaatgtttccagtaaagagtatgatgcaggggttctgcaagatcggtaaatctaccttctcttcccttgtactcggaatctactggacgtcccaagtaaaaaatgtgtgaatctatacatttagttaagtttgtattgttttctccatcctgagatagaaaacatggcttcttgcataaattgaagtttccaactcaagaacagcctttaaagaagctggcatgctgctcagtaactggggagttgctgccttccccccaccccctgagcccctggcacctagcagtgtttgttaatgaatcatagcagagacgtccatcttctccactctcctgccccaacccaggaacacatttccagagctagaaactacttactgcaactgttccaaaggtctgtgaaataaacatcacagcacagcagcattcacctgtgctatgtattaaatactattgtcagatatttagaagtctgagttctctcccttgtgggaaaagacaccgaatgtaggacctaaaataacctgatcctggaagagtcccattcgtttttggcctgatgctcttctttgggcaacagatctgactaggtgtctctggaccttggctgcacattagaatcacatggggatcttttaaaatccagatgcccaggctgcacctcagaccaatattgacatttgaatctctagaggtgggtccaggcattggtatttccccttaaaatttttaatcagaaaatattttaatgcacagaaaatttgaaacaatagtacagtgaacacccacctagatttaccaattattagcattttgtcacatttgctttctatctctatcctctatccaatctccacacatactctttttgattactttttttaatcattgggatttttggcgttttttttttttttttggagacaaggtctcactctgtcgcccaggctggagtgcagtggtgtgatcacagctcactgcagacttgacctccccaagctcggacaatcctcccaccttggcctctgtactagctgggaccacaagcacatgctgccatgccaagctaatttttcattttttatagagacgaagttttgccatgttgcccaggctggtcttgaactcctgggctcaagtgatcttcctgccttggcctcccaaagtgctgggattacaggtgtgagtcactgagcctggcctgatttttttccttaaacggtttgaaaataaattacaaacatcaggacacttcatccctaaatacttcagaatgtatctcctaagtatgaggacattctgctaggtaactgcgatagaattaacaactccggaaatgtaacattaacatgctattatctagaattagttcatattcaaatttccccagttttctcaatgtttttatagccttttaaaaatgcagaattcaattagagatcatacattatatttagttgtcatatgtctttactctttttaaatctagaataattctctagccttttaaatatcttttgtgatattgacttaagaaaaaaatatttctgtgcctagcttatttcacttaacataatgacctccagttccatccatgttgctgccaaagacaggatctcgttcttttttatggctgagtagtagtctattaggtatctataccacattttattttcttttttttaaataaattttatttttaatttttgtaggtacataggtgtatatatttatgggatacatgagatattttgatacgggaatgcagtgtgtaataatcacatcatggagaatggggtatccatcccctcaagcatttatcctttgtgttactaacaatccaattatagtcttttagtaatttgaaaatgtatgattaagttgttattgactatatcatcctgttgtgctatcaaatagtaggtcttattcattctttctaactatgttttttgtacccattaaccatccccatctcacccccgacctgctcccactacccttcctagcctctgataaccatccttctattctctatgtccattgggttcaattgtttggagttttagatcttacaaagtgagaacgtgcgatgtttgtctttcggtgcctggcttatttcacttaacataatgatctccagttccatccatgttgttgcagatgacaggatctcattctttctatggctgagtagcattccattgggtatatgtaccacagtttccttatccacttttctgttgatggacacttaagttgattgcatatctttgctactgtgaatagtgctgaggtaaacatgaagagctaaaaaggttgatctcgtggaggtagagagtagagaggttggttactggatacaaacatacagttagattgaaagaataagttctagtattcagtagcagagtagggtgactatagttgacaacaatgtgtcgtatatttcaaaatagctagaaaagaggaattgaaatgctccaaatacacagaaatgataaatgctcaaggtgatggacactcaaataccctgccttgttcactacacattctatgcatggaacaaaatatcacatgtaccccctaaaaatgtacaactattatatatgaataagaattttttttttttggctaggtgtgatgactcactcttgtaatcccagcactttgggaggctgaggcaggaggatcacttgagcccaggagttcgagaccagcctaagcaacatagcgagaccccatctttacaaaaaatacaaaaattagccagtgtggtagctcacatcggtagtcccagctacccaggaggctgaggtgggaggatcacttgagcctgggaggtcaaggctgcagtgagccaagatcacaccactgtactccagcctgggcaacagagtgagaccctgtctcaaaaaaaaaaagtttttaagaaaaaaatcagatgagttttttgtttgtttgttttgttttttttgagacagagtctcgctctgttatccagattggagtgcagtgggacaatcttggctcactgcagtctcctgggttcaagtgtttctcctgcctcagcctcccgagtagctgagactacaggagtgcgccaccatgcctggctaatttttgtatttttagtagagacagggtttcaccacattggccagatggtctcaaactcctggcctcaggtgatcctcctgcctcagcctcccaaagtgctgggattacaggcttgagcgaccatgcctgaccagatcagtttttgtaaacggctcctcattttaaatttgcatgattgtttcctcgtggttggatttaggtaaatgttgtggcagaagtattctataggtgatgttatagaagtattctataggtgacgatattctataggtccttctcagtgcagcctatcaggaggcacgtgatgtcaatttgtcctatgattagcaatgttaacttggatcacttgggtaaggctgtatctgccagctctcttcattccaaggggaccattttccttttgtaactgtggggagatactttgagatttggtaaatatcttaatccccaacaagctttcgcccagtggttttagcaaccgttgattcttcccagaatcaattattactatgatggttataaaatggctattgtctggatatttctatcatttctgtatttgtcaatgttcttttgttaaaaaaaagagaaaaaaggagctttcacttctcaccccataactatctatctgatcttctttagctagctgtctagctacctgttaaacatattaatatggactcatgaattttttaatgaatgtattgtaataaattccctcagtacataccgtattgtcccaactttggtcagtggaagccctgtctagctgactcctgtgtccttttgaaattatcccttaaatgtttgagtacttcatgaattttagcacaaccagatattttagtctcactttgtatcttctttgccgtaggcttagaagaagccatttttctatggagacctagttcctctggagctgctatttaggaaggcatcagtagttttgtgaaagctccctagtcgatttcaatatgcagcaaagaataagagacatagattagagtcttccaaggggagaccacctgttcccacaaggtgtttcttttcttttaatcacctgttatttgtggtgctgatttgttgctgagatttagattttcatgtgtgttactcaagagatagctttaaatgcaggtccctggccccaaccccaaagagtgagttcagtagttctgccttgcattttaacagtctggtgcaggtggtccccaggccatacctgtagaaaatgccagaagtaaccctggaaactgggaattaggggtttcttttgattttcctcttttgctttttatcagtggtttctaccttgcaatatgatttcagaatactgccacgttccccaggtatgtggtaaggatctaattgattaatttgatggattctttgaaaatatcagatgatttaaacccttgtagctttactcttgttccatcatggggaattggggatgtgaaaaaaagaggtggtggggtgggggtggggtgggaagctttataagtgttggaagttttcagttgacccaaagacttttttcatccaatacattatttgttgttattagtttattttcacggacactgaatgaattggcctagtaaagttttcacatgctgtaagatcctaggatgtaggctctaaaatatagttgtgtgtgctgttttggggactgggtcatgacaccgtagtcagtttctgctatttccttttctgagaaggcaattaattgcattgcctccccatccaaccagctttattttattaaatctggggcctgtagggcccaagtgcccagcagctgtaaggaaaagctcctgatttgtggtttttcccttcctggttccacctttcaaacaaataccatgttagtgcagctagtcccttctgtgatctcaagacccaggactgagaatgcttaagaacagtcagatgtgggagggagatagtgcttctggagttgcgttgcctggtttgaaatcctctggtaaaatacatgatctctatgtgcctccgaggtcttcttgtctgtaaaaagggggttagtaatctaccccagaggttcagtgtgaggattaaatggggtggcatatgtaaagtgcttagcagtctatggcacatagtaggtgctcaataaatgttactattttattaaacagtaaatggtcacaaatggaagggggccgtggggtctagtgagagagttgagggtgtgctgtctcagttatcattagatcggctattgtggtatcatagtgcttgtgatcaacgaacccttatttcacttaatacagttgttcccccttacccgtgggtgctacatttcaagacccctagtggatgcctgaaaccatgaatagtgccaagtcctatatatactatgtctttccctatacgtacatatctatgagaaagattaatttataaattaagcgcaggaagagattaacaccaataaataataataaaacactaataataaaatacaacactaacaatatactataataaaagttatgggaatgtgttctctttctctttctcaaaatatcttattgtactgtacttagccttcttatgatggtgtgagatgataaaatgcctacatgatgtaatgcagcgaggtgaatgatgtgggcattgtgacgtagcgtttggctactattgaccttctgatgatctatgagaatgaggatcatctgttttgagtgatcctggatcgtggagtcacaacgctgtctgtggttagatgtgaggagcagacagtgtcagtgactcaggggcagggaacatccgtagcgtggagacgctggacaaatggatgattcacatcccggacaggatggagcaggatggcatgaggtttcatcacactactgagaatgacatgcaattgaaaagttatgaattgtttatttctggaatattccatttaatatttttggaccttaggtggccacaggtaactgaaactgcagaaagtggaactgttgataaggggggactactgtaaaaattccactcccagttcatttggacatgaaggtggtggctcaaactaaggaattccaaacctcaggcataggcaagtcataagtttttttcctttagtttatgtgagctattgaaatgaggtggcattgtcatctccttacctctttaaggaaggtcaagactcactagtaaacaccagtgaaattccaggagaggaaaaaaatgacaaatgactttcttagacttccttaagtttaagatggatggatgcaactgaaatacaatttctcccaacttcaagcatcccccttgaactgggttgtaggtcaggtggtactggcaaacaaattcaaatcagtgacaggctatagttgaggcctcgaaaagcagcattccaggagtttggtgttctctgtaatgagaggtccatggcagagacctaagtgacgtggtacagtgttgcaggaagaagttgagtacagattgcagagagtttggcacaaaatgtgaattgaattagtttatccagcactagagagagaactatgaacttaggctaaggaaatgctgccacttactagcttggtgacctggggtaagtcattgagtcctggattcctcatttgcaaaatgattgcccattctggcttttattttttaactcatgtggttggcaggaggagagggtgatggatatcagaagggtttgtgagctatcccagtgcgagggcgaatgattgtgcttggcatcaggtcacgtgatctttaccaccagccacctctgggtccctcccctgtgccctctgtagggcttactctttggcatgttggcagtgagctttgtaggactttatgctaccaaaacagtaacagtcatgaggctggactagcctggcagagagaaagtagcgaagacatcattcttctgacaccaggcaggcctttatggaagtccgatgcggggatttggtttaagagcagtctcattattctgtttcaggtcctacatccattgggttagtcttttctctaagaatagatcactctctcctttgccatttgtgcagtgttggattagatgctactttttacagagggttttttgaacatatgaacttacatacaactgtaagttttatggcttcagctaacactagatcttcagatggtgttattttaagtcactttggtcaggactttgacttctgtggttgtgagtgttggttttcagacgtttgtcatttcacttgtttcatgttcagatttgtgtctgcagagtttgcttttaacataacatccagcaaatgaaagccctttaaagattggtagtagaacttcattttaagaagcatctatggggccagtggagtcgcaggggtcaggagtgggatgccaagattgccttgtaatctagactttctttgctagaatgagaaatccatatcctttatggtacagggtacttgatttgccttccattgtatgggaagccatggtatagtggtggcgttctttgcatcggaatacccattcctcctgactttcctccttggaaaagcaagttggagtgggccctctgtcctagggagagccaagccctccttggggttgcactactcagcctgctgacagtgccatcagcatctaggaattgccctggaaatgctgtgtttgttcctaagacccagaggcttgtaattttgcacaaaggggtggagagtatttgtggagtcaccaaagatgtgattagacaagatatcgattctgaacttctgccctcttccttctattcaactctgttcttgcttagtgaggtacaggcaagaaaaatggaacagagagaactaggctgccggcttttgaaacatattgatcagggcacacatccgatgtagcacagagaccttcccctttatatgatgtcatcctgcattggggccttaatgtgccctgtgatcacctctgcatggacttcctttctcagagaaaagattagagaagaaaaagaatccctgtaggcagtgctaaaaaataatttaagcatttctaaatgtgtttctttgaagtcattgatccctttggttttctaggccatgcagtggcatgaaggaatggtgtgaggcggtcagccatgaacgacaaacttctgagcaatgtcggtctcacttcctacctcccatccacctccctggcttgggcctccactgctgtctgtctgtctgtctgtctgtctgtctgtctgtctgtctcaccctcacccccatacacgttctttctccacatagtgcacatctgtggtgtggatatgctgtggacagttgtgtctgtacttgaaccagctctaagccagggtctcccagataggacatgctgggtgagtgagatgttgtaaccctgagtgtcctctggttgagtgaagtgtggccctggctcttatcttgatttgtctggcttggttctgcgtaagtagctggggatcctgttaatggatcccctgggacagagggaagaggacagaagtagatttgttgaatcctgtgggggtgtttgaaatggtaccaagagcaggctgaaatctaatcagccttcacttatcaggcttgagttcccgtatgttgaaagggtgacgattagtaagaaaaaggccaggatactttatctttcctttgcacatttagaaaaatcccctctgccttgctagcattagaagcagaccattcttttttctctaccacatcacatcagcttccattaaaaatcaacagcagcaaatacaaagccccatctatggaaaaccgtttaaggcaacactgtgctccagtgcttcaggggtggggtatttgccttctgcaccaatggatcggtttctcatatccatgcctttctgacccagcagcttttaaaagaccaagaagcattgctctgctttctactgcctctctctaagagaccagggctgccgtgcctcaagccatgtcccagagagcatatttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaat

SEQ ID NO: 3221 - DNA, 134172 bp, human
actcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagag

SEQ ID NO: 3222 - DNA, 136991 bp, human
tttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaa

SEQ ID NO: 3223 - DNA, 171687 bp, human; identical to SEQ ID NO: 3216

SEQ ID NO: 3224 - DNA, 264058 bp, human; identical to SEQ ID NO: 3217

SEQ ID NO: 3225 - DNA, 353626 bp, human; identical to SEQ ID NO: 3218

SEQ ID NO: 3226 - DNA, 353636 bp, human; identical to SEQ ID NO: 3219

SEQ ID NO: 3227 - DNA, 209997 bp, human; identical to SEQ ID NO: 3220

SEQ ID NO: 3228 - DNA, 134172 bp, human; identical to SEQ ID NO: 3221

SEQ ID NO: 3229 - DNA, 136991 bp, human; identical to SEQ ID NO: 3222

SEQ ID NO: 3230 - DNA, 171687 bp, human; identical to SEQ ID NO: 3216

SEQ ID NO: 3231 - DNA, 264058 bp, human; identical to SEQ ID NO: 3217

SEQ ID NO: 3232 - DNA, 353626 bp, human; identical to SEQ ID NO: 3218

SEQ ID NO: 3233 - DNA, 353636 bp, human; identical to SEQ ID NO: 3219

SEQ ID NO: 3234 - DNA, 209997 bp, human; identical to SEQ ID NO: 3220

SEQ ID NO: 3235 - DNA, 134172 bp, human; identical to SEQ ID NO: 3221

SEQ ID NO: 3236 - DNA, 136991 bp, human; identical to SEQ ID NO: 3222

SEQ ID NO: 3237 - DNA, 171687 bp, human; identical to SEQ ID NO: 3216

SEQ ID NO: 3238 - DNA, 264058 bp, human; identical to SEQ ID NO: 3217

SEQ ID NO: 3239 - DNA, 353626 bp, human; identical to SEQ ID NO: 3218

SEQ ID NO: 3240 - DNA, 72647 bp, human
ctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaa
